US010781264B2

(12) United States Patent
Raum et al.

(10) Patent No.: US 10,781,264 B2
(45) Date of Patent: Sep. 22, 2020

(54) PSMA AND CD3 BISPECIFIC T CELL ENGAGING ANTIBODY CONSTRUCTS

(71) Applicant: AMGEN RESEARCH (MUNICH) GMBH, Munich (DE)

(72) Inventors: Tobias Raum, Munich (DE); Markus Münz, Munich (DE); Johannes Brozy, Munich (DE); Peter Kufer, Munich (DE); Patrick Hoffmann, Munich (DE); Matthias Friedrich, Munich (DE); Benno Rattel, Munich (DE); Pamela Bogner, Munich (DE); Andreas Wolf, Munich (DE); Cornelius Pompe, Munich (DE)

(73) Assignee: AMGEN RESEARCH (MUNICH) GMBH, Munich (DE)

( * ) Notice: Subject to any disclaimer, the term of this patent is extended or adjusted under 35 U.S.C. 154(b) by 0 days.

(21) Appl. No.: 15/422,661

(22) Filed: Feb. 2, 2017

(65) Prior Publication Data
US 2017/0218079 A1 Aug. 3, 2017

Related U.S. Application Data

(60) Provisional application No. 62/290,875, filed on Feb. 3, 2016.

(51) Int. Cl.
A61K 39/00 (2006.01)
C07K 16/30 (2006.01)
C07K 16/28 (2006.01)

(52) U.S. Cl.
CPC ...... C07K 16/3069 (2013.01); C07K 16/2809 (2013.01); A61K 2039/505 (2013.01); C07K 2317/31 (2013.01); C07K 2317/52 (2013.01); C07K 2317/524 (2013.01); C07K 2317/526 (2013.01); C07K 2317/53 (2013.01); C07K 2317/622 (2013.01); C07K 2317/64 (2013.01)

(58) Field of Classification Search
CPC .............................................. A61K 2039/505
See application file for complete search history.

(56) References Cited

U.S. PATENT DOCUMENTS

| | | |
|---|---|---|
| 3,691,016 A | 9/1972 | Patel et al. |
| 3,773,919 A | 11/1973 | Boswell et al. |
| 3,969,287 A | 7/1976 | Jaworek et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,301,144 A | 11/1981 | Iwashita et al. |
| 4,330,440 A | 5/1982 | Ayers et al. |
| 4,439,196 A | 3/1984 | Higuchi |
| 4,447,224 A | 5/1984 | DeCant, Jr. et al. |
| 4,447,233 A | 5/1984 | Mayfield |
| 4,475,196 A | 10/1984 | La Zor |
| 4,485,045 A | 11/1984 | Regen |
| 4,486,194 A | 12/1984 | Ferrara |
| 4,487,603 A | 12/1984 | Harris |
| 4,496,689 A | 1/1985 | Mitra |
| 4,544,545 A | 10/1985 | Ryan et al. |
| 4,596,556 A | 6/1986 | Morrow et al. |
| 4,640,835 A | 2/1987 | Shimizu et al. |
| 4,670,417 A | 6/1987 | Iwasaki et al. |
| 4,694,778 A | 9/1987 | Learn et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |
| 5,013,556 A | 5/1991 | Woodle et al. |
| 5,064,413 A | 11/1991 | McKinnon et al. |
| 5,223,409 A | 6/1993 | Ladner et al. |
| 5,225,539 A | 7/1993 | Winter |
| 5,260,203 A | 11/1993 | Ladner et al. |
| 5,292,658 A | 3/1994 | Cormier et al. |
| 5,312,335 A | 5/1994 | McKinnon et al. |
| 5,383,851 A | 1/1995 | McKinnon, Jr. et al. |
| 5,399,163 A | 3/1995 | Peterson et al. |

(Continued)

FOREIGN PATENT DOCUMENTS

| | | |
|---|---|---|
| CN | 104829726 | 8/2015 |
| CN | 104829728 | 8/2015 |

(Continued)

OTHER PUBLICATIONS

Fortmüller et al. (Prostate. May 2011; 71 (6): 588-96).*
Cheng et al. (Int. J. Cancer. Jan. 15, 2015; 136 (2): 476-86).*
Ha et al. (Front. Immunol. Oct. 6, 2016; 7: 394; pp. 1-16).*
Zhou et al. (Biomaterials. Feb. 2017; 117: 24-31).*
Friedrich et al. (Mol. Cancer Ther. Dec. 2012; 11 (12): 2664-73).*
Bacac et al. (Clin. Cancer Res. Jul. 1, 2016; 22 (13): 3286-97).*
Zou et al. (Cancer Sci. May 2015; 106 (5): 512-21).*
U.S. Appl. No. 07/466,008, Kucherlapati et al.
U.S. Appl. No. 07/574,748, Kay et al.
U.S. Appl. No. 07/575,962, Lonberg et al.

(Continued)

Primary Examiner — Stephen L Rawlings
(74) Attorney, Agent, or Firm — Marshall, Gerstein & Borun LLP

(57) ABSTRACT

The present invention provides bispecific antibody constructs of a specific Fc modality characterized by comprising a first domain binding to PSMA, a second domain binding to an extracellular epitope of the human and the *Macaca* CD3ε chain and a third domain, which is the specific Fc modality. Moreover, the invention provides a polynucleotide, encoding the antibody construct, a vector comprising this polynucleotide, host cells, expressing the construct and a pharmaceutical composition comprising the same.

22 Claims, 10 Drawing Sheets
Specification includes a Sequence Listing.

(56) References Cited

U.S. PATENT DOCUMENTS

| | | |
|---|---|---|
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,673,986 B1 | 1/2004 | Kucherlapati et al. |
| 9,034,324 B2 | 5/2015 | Kalled et al. |
| 9,150,664 B2 | 10/2015 | Kufer et al. |
| 9,243,058 B2 | 1/2016 | Armitage et al. |
| 9,340,621 B2 | 5/2016 | Kufer et al. |
| 9,598,500 B2 | 3/2017 | Kufer et al. |
| 9,725,506 B2 | 8/2017 | Dillon et al. |
| 10,220,090 B2 | 3/2019 | Armitage et al. |
| 10,294,300 B2 | 5/2019 | Raum et al. |
| 10,301,391 B2 | 5/2019 | Raum et al. |
| 2003/0070185 A1 | 4/2003 | Jakobovits et al. |
| 2008/0260738 A1 | 10/2008 | Moore et al. |
| 2009/0304696 A1* | 12/2009 | Lawson ............... C07K 16/00 424/135.1 |
| 2010/0150918 A1 | 6/2010 | Kufer et al. |
| 2011/0275787 A1 | 11/2011 | Kufer et al. |
| 2011/0293619 A1 | 12/2011 | Kufer et al. |
| 2013/0129723 A1 | 5/2013 | Blankenship et al. |
| 2013/0273055 A1 | 10/2013 | Borges et al. |
| 2013/0287774 A1 | 10/2013 | Zugmaier et al. |
| 2014/0200331 A1 | 7/2014 | Corper et al. |
| 2014/0302037 A1 | 10/2014 | Borges et al. |
| 2014/0308285 A1 | 10/2014 | Yan et al. |
| 2015/0023967 A1 | 1/2015 | Kufer et al. |
| 2015/0368343 A1 | 12/2015 | Xiao et al. |
| 2015/0376287 A1 | 12/2015 | Vu et al. |
| 2016/0176973 A1 | 6/2016 | Kufer et al. |
| 2017/0029502 A1 | 2/2017 | Raum et al. |
| 2017/0029512 A1 | 2/2017 | Raum et al. |
| 2017/0037130 A1 | 2/2017 | Raum et al. |
| 2017/0037149 A1 | 2/2017 | Raum et al. |
| 2017/0129961 A1 | 5/2017 | Raum et al. |
| 2017/0165373 A1 | 6/2017 | Armitage et al. |
| 2017/0218077 A1 | 8/2017 | Raum et al. |
| 2017/0218078 A1 | 8/2017 | Raum et al. |
| 2017/0275373 A1 | 9/2017 | Kufer et al. |
| 2017/0349668 A1 | 12/2017 | Rattel et al. |

FOREIGN PATENT DOCUMENTS

| | | | |
|---|---|---|---|
| EP | 0036676 A1 | 9/1981 | |
| EP | 0058481 A1 | 8/1982 | |
| EP | 0088046 A2 | 9/1983 | |
| EP | 0133988 A2 | 3/1985 | |
| EP | 0143949 A1 | 6/1985 | |
| EP | 0171496 A2 | 2/1986 | |
| EP | 0173494 A2 | 3/1986 | |
| EP | 0183070 A2 | 6/1986 | |
| EP | 0239400 A2 | 9/1987 | |
| EP | 0244234 A2 | 11/1987 | |
| EP | 0402226 A1 | 12/1990 | |
| EP | 0463151 A1 | 1/1992 | |
| EP | 0546073 A1 | 6/1993 | |
| EP | 0773288 A2 | 5/1997 | |
| EP | 0843961 A1 | 5/1998 | |
| GB | 2177096 A | 1/1987 | |
| JP | 3 068 180 B2 | 7/2000 | |
| JP | 3 068 506 B2 | 7/2000 | |
| WO | WO-1987/005330 A1 | 9/1987 | |
| WO | WO-1988/001649 A1 | 3/1988 | |
| WO | WO-1988/009344 A1 | 12/1988 | |
| WO | WO-1992/003918 A1 | 3/1992 | |
| WO | WO-1992/015673 A1 | 9/1992 | |
| WO | WO-1992/022645 A1 | 12/1992 | |
| WO | WO-1992/022647 A1 | 12/1992 | |
| WO | WO-1992/022670 A1 | 12/1992 | |
| WO | WO-1993/012227 A1 | 6/1993 | |
| WO | WO-1993/015722 A1 | 8/1993 | |
| WO | WO-1994/000569 A1 | 1/1994 | |
| WO | WO-1994/002602 A1 | 2/1994 | |
| WO | WO-1994/025585 A1 | 11/1994 | |
| WO | WO-1995/007463 A1 | 3/1995 | |
| WO | WO-1996/014436 A1 | 5/1996 | |
| WO | WO-1996/033735 A1 | 10/1996 | |
| WO | WO-1996/034096 A1 | 10/1996 | |
| WO | WO-1997/013852 A1 | 4/1997 | |
| WO | WO-1997/038731 A1 | 10/1997 | |
| WO | WO-1998/014605 A1 | 4/1998 | |
| WO | WO-1998/024884 A1 | 6/1998 | |
| WO | WO-1998/024893 A2 | 6/1998 | |
| WO | WO-1998/026277 A2 | 6/1998 | |
| WO | WO-1998/052976 A1 | 11/1998 | |
| WO | WO-1999/049019 A2 | 9/1999 | |
| WO | WO-1999/054440 A1 | 10/1999 | |
| WO | WO-2000/006605 A2 | 2/2000 | |
| WO | WO-2000/034317 A2 | 6/2000 | |
| WO | WO-2000/076310 A1 | 12/2000 | |
| WO | WO-2003/047336 A2 | 6/2003 | |
| WO | WO-2005/040220 A1 | 5/2005 | |
| WO | WO-2005077981 A2 * | 8/2005 | ............. C07K 16/00 |
| WO | WO-2006/138181 A2 | 12/2006 | |
| WO | WO-2007/042261 A2 | 4/2007 | |
| WO | WO-2008/119567 A2 | 10/2008 | |
| WO | WO-2008119567 A2 * | 10/2008 | ........... C07K 16/082 |
| WO | 2010/037836 A2 | 4/2010 | |
| WO | WO-2010/037838 A2 | 4/2010 | |
| WO | WO2010037836 A2 * | 4/2010 | |
| WO | 2011/121110 A1 | 10/2011 | |
| WO | 2012/088461 | 6/2012 | |
| WO | WO-2013/026833 A1 | 2/2013 | |
| WO | WO-2013/026837 A1 | 2/2013 | |
| WO | 2013/072406 A1 | 5/2013 | |
| WO | 2013/072415 A1 | 5/2013 | |
| WO | WO-2013/092001 | 6/2013 | |
| WO | WO-2013/128027 A1 | 9/2013 | |
| WO | WO-2014/100490 | 6/2014 | |
| WO | 2014/138449 | 9/2014 | |
| WO | 2014/140248 A1 | 9/2014 | |
| WO | WO-2014/140358 A1 | 9/2014 | |
| WO | WO-2014/144722 A2 | 9/2014 | |

(56) References Cited

FOREIGN PATENT DOCUMENTS

| WO | WO-2014/151910 A1 | 9/2014 | |
|---|---|---|---|
| WO | WO-2014153063 A1 * | 9/2014 | ............. C07K 14/55 |
| WO | WO-2015/048272 A1 | 4/2015 | |
| WO | WO-2015/063187 | 5/2015 | |
| WO | WO-2015/107015 | 7/2015 | |
| WO | WO-2015/181805 | 12/2015 | |

OTHER PUBLICATIONS

U.S. Appl. No. 07/610,515, Kucherlapati et al.
U.S. Appl. No. 07/904,068, Lonberg et al.
U.S. Appl. No. 07/919,297, Kucherlapati et al.
U.S. Appl. No. 08/112,848, Kucherlapati et al.
U.S. Appl. No. 08/155,301, Lonberg et al.
U.S. Appl. No. 08/161,739, Lonberg et al.
U.S. Appl. No. 08/165,699, Lonberg et al.
U.S. Appl. No. 08/209,741, Kay et al.
U.S. Appl. No. 08/234,145, Kucherlapati et al.
U.S. Appl. No. 08/376,279, Kucherlapati et al.
U.S. Appl. No. 08/430,938, Kucherlapati et al.
U.S. Appl. No. 08/462,837, Kucherlapati et al.
U.S. Appl. No. 08/463,191, Kucherlapati et al.
U.S. Appl. No. 08/464,584, Kucherlapati et al.
U.S. Appl. No. 08/486,853, Kucherlapati et al.
U.S. Appl. No. 08/486,859, Kucherlapati et al.
U.S. Appl. No. 08/759,620, Jakobovits et al.
Altschul et al., Basic local alignment tool. *J. Mol. Biol.* 215: 403-10 (1990).
Altschul et al., Gapped BLAST and PSI-BLAST: a new generation of protein database search programs. Nucl. Acids Res. 25(17): 3389-402 (1997).
Altschul et al., Local alignment statistics. *Meth. Enzymol.* 266: 460-80 (1996).
Aplin et al., Preparation, properties, and applications of carbohydrate conjugates of proteins and lipids. CRC Crit. Rev. Biochem. 259-306 (1981).
Arakawa et al., Solvent interactions in pharmaceutical formulations. *Pharm. Res.* 8(3): 285-91 (1991).
Artsaenko et al., The expression of a single-chain Fv antibody against abscisic acid creates a wilty phenotype in transgenic tobacco. *The Plant J.* 8: 745-50 (1995).
Bird et al., Single-chain antigen-binding proteins. *Science* 242: 423-26 (1988).
Brühl et al., Depletion of CCR5-expressing cells with bispecific antibodies and chemokine toxins: a new strategy in the treatment of chronic inflammatory diseases and HIV. *Immunol.* 166: 2420-6 (2001).
Burger et al., Expression analysis of delta-catenin and prostate-specific membrane antigen: their potential as diagnostic markers for prostate cancer. *Int. J. Cancer* 100: 228-37 (2002).
Carter et al., High level *Escherichia coli* expression and production of a bivalent humanized antibody fragment. *Biotechnology* 10: 163-7 (1992).
Chalfie et al., Green fluorescent protein as a marker for gene expression. *Science* 263: 802-5 (1994).
Chang et al., Comparison of anti-prostate-specific membrane antigen antibodies and other immunomarkers in metastatic prostate carcinoma. *Urology* 57: 1179-83 (2001).
Chang et al., Five different anti-prostate-specific membrane antigen (PSMA) antibodies confirm PSMA expression in tumor-associated neovasculature. *Cancer Res.* 59: 3192-98 (1999).
Cheadle et al., Cloning and expression of the variable regions of mouse myeloma protein MOPC315 in *E. coli*: recovery of active FV fragments. *Mol. Immunol.* 29: 21-30 (1992).
Cheson et al., Report of an international workshop to standardize response criteria for Non-Hodgkin's Lymphomas. *J. Clin. Oncol.* 17(4): 1244-53 (1999).
Chothia et al., Canonical structures for the hypervariable regions of immunoglobulins. *J. Mol. Biol.* 196: 901-17 (1987).
Chothia et al., Conformation of immunoglobulin hypervariable regions. *Nature* 342: 877-83 (1989).
Clackson et al., Making antibody fragments using phage display libraries. *Lett. Nature* 352: 624-8 (1991).
Cook et al., the human immunoglobulin VH repertoire. *Immunol. Today* 16(5): 237-42 (1995).
Dall'Acqua et al., Contribution of domain interface residues to the stability of antibody CH3 domain homodimers. *Biochemistry* 37: 9266-73 (1998).
Duskin et al., Relationship of the structure and biological activity of the natural homologues of tunicamycin. *J. Biol. Chem.* 257(6): 3105-9 (1982).
Edge et al., Deglycosylation of glycoproteins by trifluoromethanesulfonic acid. *Anal. Biochem.* 118: 131-7 (1981).
Eppstein et al., Biological activity of liposome-encapsulated murine interferon γ is mediated by a cell membrane receptor. *Proc. Natl. Acad. Sci. USA* 82: 3688-92 (1985).
Fecker et al., Expression of single-chain antibody fragments (scFv) specific for beet necrotic yellow vein virus coat protein or 25 kDa protein in *Escherichia coli* and *Nicotiana benthamiana*. *Plant Mol. Biol.* 32: 979-86 (1996).
Feng et al., Progressive sequence alignment as a prerequisite to correct phylogenetic trees. *J. Mol. Evol..* 35: 351-60 (1987).
Gabizon et al., Pharmacokinetics and tissue distribution of doxorubicin encapsulated in stable liposomes with long circulation times. *J. National Cancer Inst.* 81(19): 1484-8 (1989).
Graham et al., Characteristics of a human cell line transformed by DNA from human adenovirus type 5. *J. Gen. Virol.* 36: 59-74 (1977).
Green et al., Antigen-specific human monoclonal antibodies from mice engineered with human Ig heavy and light chain YACs. *Nat. Genet.* 7: 13-21 (1994).
Green et al., Regulation of B cell development by variable gene complexity in mice reconstituted with human immunoglobulin yeast artificial chromosomes. *J. Exp. Med.* 188: 483-95 (1998).
Hakimuddin et al., A chemical method for the deglycosylation of proteins. *Arch. Biochem. Biophys.* 259: 52-7 (1987).
Hawkins et al., Selection of phage antibodies by binding affinity. *J. Mol. Biol.* 254: 889-96 (1992).
Heim et al., Engineering green fluorescent protein for improved brightness, longer wavelengths and fluorescence resonance energy transfer. *Curr. Biol.* 6: 178-82 (1996).
Hiatt et al., Production of antibodies in transgenic plants. *Nature* 342: 76-8 (1989).
Higgins et al., Fast and sensitive multiple sequence alignments on a microcomputer. *CABIOS* 5: 151-3 (1989).
Holliger et al., "Diabodies": Small bivalent and bispecific antibody fragments. *Proc. Natl. Acad. Sci. USA* 90(14): 6444-8 (1993).
Horoszewicz et al., Monoclonal antibodies to a new antigenic marker in epithelial prostatic cells and serum of prostatic cancer patients. *Anticancer Res.* 7: 927-35 (1987).
Hubert et al., STEAP: a prostate-specific cell-surface antigen highly expressed in human prostate tumors. *Pros. Natl. Acad. Sci. USA* 96: 14523-8 (1999).
Huston et al., Protein engineering of antibody binding sites: recovery of specific activity in an anti-digoxin single-chain Fv analogue produced in *Escherichia coli*. *Proc. Natl. Acad. Sci. USA* 85: 5879-83 (1988).
Hwang et al., Hepatic uptake and degradation of unilamellar sphingomyelin/cholesterol liposomes: A kinetic study. *Proc. Natl. Acad. Sci. USA* 77: 4030-4 (1980).
Hwang et al., Use of human germline genes in a CDR homology-based approach to antibody humanization. *Methods* 36(1): 35-42 (2005).
Israeli et al., Expression of the prostate-specific membrane antigen. *Cancer Res.* 54: 1807-11 (1994).
Israeli et al., Molecular cloning of a complementary DNA encoding a prostate-specific membrane antigen. *Cancer Res.* 53: 227-30 (1993).
Jones et al., Replacing the complementarity-determine regions in a human antibody with those from a mouse. *Nature*, 321: 522-5 (1986).

(56) References Cited

OTHER PUBLICATIONS

Karlin et al., Applications and statistics for multiple high-scoring segments in molecular sequences. *Proc. Natl. Acad. Sci. USA* 90: 5873-7 (1993).
Kawakami et al., Enhanced expression of prostate-specific membrane antigen gene in prostate cancer as revealed by in situ hybridization. Cancer Res. 57: 2321-4 (1997).
Kipriyanov et al., Bispecific tandem diabody for tumor therapy with improved antigen binding and pharmacokinetics. *J. Mol. Biol.* 293: 41-56 (1999).
Kohler et al., Continuous cultures of fused cells secreting antibody of predefined specificity. *Nature*, 256:495-7 (1975).
Kozbor et al., The production of monoclonal antibodies from human lymphocytes. *Immunol. Today*, 4(3): 72-9 (1983).
Kufer et al., A revival of bispecific antibodies. *Trends Biotechnol.* 22(5): 238-44 (2004).
Kufer et al., Construction and biological activity of a recombinant bispecific single-chain antibody designed for therapy of minimal residual colorectal cancer. *Cancer Immunol. Immunother.* 45: 193-7 (1997).
Langer et al., Biocompatibility of polymeric delivery systems for macromolecules. *J. Biomed. Mater. Res.* 15(2): 267-77 (1981).
Langer, Controlled release of macromolecules. *Chem. Tech.* 12: 98-105 (1982).
Liu et al., Monoclonal antibodies to the extracellular domain of prostate-specific membrane antigen also react with tumor vascular endothelium. Cancer Res. 57: 3629-34 (1997).
Lopes et al., Immunohistochemical and pharmacokinetic characterization of the site-specific immunoconjugate CYT-356 derived from antiprostate monoclonal antibody 7E11-05. *Cancer Res.* 50: 6423-9 (1990).
Lowman et al., Selecting high-affinity binding proteins by monovalent phage display. *Biochemistry* 30: 10832-7 (1991).
Löffler et al., A recombinant bispecific single-chain antibody, CD19 x CD3, induces rapid and high lymphoma-directed cytotoxicity by unstimulated T lymphocytes. *Blood* 95(6): 2098-103 (2000).
MacCallum et al., Antibody-antigen intractions: Contact analysis and binding site technology. *J. Mol. Biol.* 262: 732-45 (1996).
Mack et al., A small bispecific antibody construct expressed as a functional single-chain molecule with high tumor cell cytotoxicity. *Proc. Natl. Acad. Sci. USA* 92(15): 7021-5 (1995).
Mack et al., Biologic properties of a bispecific single-chain antibody directed against 17-1A (EpCAM) and CD3: tumor cell-dependent T cell stimulation and cytotoxic activity. *J. Immunol.* 158: 3965-70 (1997).
Malmborg et al., BIAcore as a tool in antibody engineering. *J. Immunol. Meth.* 183: 7-13 (1995).
Marks et al., By-passing immunization: Human antibodies from V-gene libraries displayed on phage. *J. Mol. Biol.* 222:581-97 (1991).
Martin et al., Irreversible coupling of immunoglobulin fragments to preformed vesicles. *J. Biol. Chem.* 257: 286-8 (1982).
Martin et al., Structural families in loops of homologous proteins: automatic classification, modelling and application to antibodies. *J. Mol. Biol.* 263: 800-15 (1996).
Mather et al., Culture of testicular cells in hormone-supplemented serum-free medium. *Ann. N.Y. Acad. Sci.* 383: 44-68 (1982).
Mather, Establishment and characterization of two distinct mouse testicular epithelial cell lines. *Biol. Reprod.* 23: 243-51 (1980).
Mendez et al., Functional transplant of megabase human immunoglobulin loci recapitulates human antibody response in mice. *Nat. Genet.* 15: 146-56 (1997).
Morrison et al., Chimeric human antibody molecules: mouse antigen-binding domains with human constant region domains. *Proc. Natl. Acad. Sci. USA* 81: 6851-5 (1984).
Morrison et al., Combinatorial alanine-scanning. *Curr. Opin. Chem. Biol.* 5(3): 302-7 (2001).
Morrison, Transfectomas provide novel chimeric antibodies. *Science*, 229(4719): 1202-7 (1985).
Murphy et al., Evaluation and comparison of two new prostate carcinoma markers. Free-prostate specific antigen and prostate specific membrane antigen. *Cancer* 78: 809-18 (1996).
Needleman et al., A general method applicable to the search for similarities in the amino acid sequence of two proteins. *J. Mol. Biol.* 48: 443-53 (1970).
Nolan et al., Fluorescence-activated cell analysis and sorting of viable mammalian cells based on beta-D-galactosidase activity after transduction of *Escherichia coli* lacZ. *Proc. Natl. Acad. Sci. USA* 85: 2603-7 (1988).
O'Keefe et al., Mapping, genomic organization and promoter analysis of the human prostate-specific membrane antigen gene. *Biochem. Biophys. Acta*, 1443: 113-27 (1998).
Olsson et al., Human-human monoclonal antibody-producing hybridomas: Technical aspects. *Meth. Enzymol.* 92: 3-16 (1982).
Owen et al., Synthesis of a functional anti-phytochrome single-chain Fv protein in transgenic tobacco. *Bio/Technology* 10: 790-4 (1992).
Padlan, Anatomy of the antibody molecule. *Molec. Immunol.* 31(3): 169-217 (1993).
Pearson et al., Improved tools for biological sequence comparison. *Proc. Natl. Acad. Sci. USA* 85:2444-8 (1988).
Presta, Antibody engineering. *Curr. Op. Struct. Biol.* 2: 593-6 (1992).
Raag et al., Single-chain Fvs. *FASEB J.* 9(1): 73-80 (1995).
Randolph et al., Surfactant-protein interactions. *Pharm Biotechnol.* 13: 159-75 (2002).
Reiter et al., Prostate stem cell antigen: a cell surface marker overexpressed in prostate cancer. *Proc. Nat. Acad. Sci. USA* 95: 1735-40 (1998).
Riechmann et al., Reshaping human antibodies for therapy. *Nature* 332: 323-9 (1988).
Ross et al., Correlation of primary tumor prostate-specific membrane antigen expression with disease recurrence in prostate cancer. *Clin. Cancer Res.* 9: 6357-62 (2003).
Schier et al., Efficient in vitro affinity maturation of phage antibodies using BIAcore guided selections. *Hum. Antibodies Hybridomas* 7(3): 97-105 (1996).
Schlereth et al., T-cell activation and B-cell depletion in chimpanzees treated with a bispecific anti-CD19/anti-CD3 single-chain antibody construct. *Cancer Immunol. Immunother.* 55: 503-14 (2006).
Sidman et al., Controlled release of macromolecules and pharmaceuticals from synthetic polypeptides based on glutamic acid. *Biopolymers* 2: 547-56 (1983).
Skerra et al., Assembly of a functional immunoglobulin Fv fragment in *Escherichia coli*. *Science*, 242: 1038-41 (1988).
Smith et al., Comparison of biosequences. *Adv. Appl. Math.* 2: 482-9 (1981).
Smith, Filamentous fusion phage: Novel expression vectors that display cloned antigens on the virion surface. *Science* 228: 1315-7 (1985).
Sokoloff et al., A dual-monoclonal sandwich assay for prostate-specific membrane antigen: levels in tissues, seminal fluid and urine. *Prostate* 43: 150-7 (2000).
Songsivilai et al., Bispecific antibody: a tool for diagnosis and treatment of disease. *Clin. Exp. Immunol.* 79: 315-21 (1990).
Stauber et al., Development and applications of enhanced green fluorescent protein mutants. *Biotechniques* 24: 462-71 (1998).
Sweat et al., Prostate-specific membrane antigen expression is greatest in prostate adenocarcinoma and lymph node metastases. *Urology* 52: 637-40 (1998).
Takeda et al., Construction of chimaeric processed immunoglobulin genes containing mouse variable and human constant region sequences. *Nature* 314: 452-4 (1985).
Teng et al., Construction and testing of mouse—human heteromyelomas for human monoclonal antibody production. *Proc. Natl. Acad. Sci. USA* 80: 7308-12 (1983).
Thotakura et al., Enzymatic deglycosylation of glycoproteins. *Meth. Enzymol.* 138: 350-9 (1987).
Tomlinson et al., The repertoire of human germline VH sequences reveals about fifty groups of VH segments with different hypervariable loops. *J. Mol. Biol.* 227: 776-98 (1992).

(56) References Cited

OTHER PUBLICATIONS

Tomlinson et al., The structural repertoire of the human V kappa domain. *EMBO J.* 14: 4628-38 (1995).
Troyer et al., Detection and characterization of the prostate-specific membrane antigen (PSMA) in tissue extracts and body fluids. *Int. J. Cancer* 62: 552-8 (1995).
Urlaub et al., Isolation of Chinese hamster cell mutants deficient in dihydrofolate reductase activity. *Proc. Natl. Acad. Sci. USA* 77: 4216-20 (1980).
Ward et al., Binding activities of a repertoire of single immunoglobulin variable domains secreted from *Escherichia coli*. Lett. *Nature* 341: 544-6 (1989).
Wright et al., Upregulation of prostate-specific membrane antigen after androgen-deprivation therapy. *Urology* 48: 326-34 (1996).
Beckman et al., Antibody constructs in cancer therapy. Cancer, 109(2): 170-79 (2007).
Bellucci et al., Graft-versus-tumor response in patients with multiple myeloma is associated with antibody response to BCMA, a plasma-cell membrane receptor. Blood, 105(10): 3945-50 (2005).
Bork et al. Go hunting in sequence databases but watch out for the traps. Trends in Genetics, 12(101):425-427 (1996).
Bork, A. Powers and pitfalls in sequence analysis: the 70% hurdle. Genome Res., 10: 398-400 (2000).
Brenner, S.E. Errors in genome function. Trends in Genetics, 15(4): 132-133 (1999).
Brummell et al., Probing the combing site of an anti-carbohydrate antibody by saturation-mutagenesis: role of heavy-chain CDR3 residues. Biochemistry, 32:1180-1187 (1993).
Burks et al., In vitro scanning saturation mutagenesis of an antibody binding pocket. PNAS, 94:412-417 (1997).
Carpenter et al. B-cell maturation antigen is a promising target for adoptive T-cell therapy of mutliple myeloma. Clin Cancer Res., 19( 8): 2048-60 (2013).
Casset et al., A peptide mimetic of an anti-CD4 monoclonal antibody by rational design. Biochemical and Biophysical Research Communications, 307: 198-205 (2003).
Colman, Effects of amino acid sequence changes on antibody-antigen interactions. Research in Immunol., 145:33-36 (1994).
Coquery et al., Regulatory roles the tumor necrosis factor receptor BCMA. Crit, Rev, Immunol., 32(4): 287-305 (2010).
Doerks et al., Protein annotation: detective work for function prediction. Trends in Genetics, 14(6): 248-50 (1998).
Fujimori et al., A modeling analysis of monoclonal antibody percolation through tumors: A binding-site barrier. J. Nuc. Med., 31(7): 1191-98 (1990).
Hay et al., Clinical development success rates for investigational drugs. Nature Biotechnology, 32(1):40-51 (2014).
Huntington et al. A BAFF antagonist suppresses experimental autoimmune encephalomyelitis by targeting cell-mediated and humoral immune responses. Int, Immunol., 18(10): 1473-85 (2006).
Ichiki et al., Regulation of the expression of human C epsilon germline transcript. Identification of a novel IL-4 responsive element. J. Immunol. 150: 5408-17 (1993).
Jang et al., The Structual basis for DNA binding by an anti-DNA autoantibody. Molec. Immunol., 35:1207-17 (1998).
Jubala et al., CD20 expression in normal canine B cells and in canine non hodgkin-lymphoma. Vet Pathol. 42: 468-76 (2005).
Kobayashi et al., Tryptophan H33 plays an important role in pyrimidine (6-4) pyrimidone photoproduct binding by a high-affinity antibody. Protein Engineering, 12:879-844 (1999).
Kontermann, R. Dual targeting strategies with bispecific antibodies. mAbs 4(2): 182-197 (2012).
Kumar et al., Molecular cloning and expression of the Fabs of human autoantibodies in *Escherichia coli*. Determination of the heavy or light chain contribution to the anti-DNA/-cardiolipin activity of the Fab. J. Biol. Chem., 275:35129-36 (2000).
Matthias et al., Regression of human prostate cancer xenografts in mice by AMG 212/BAY2010112, a novel PSMA/CD3-Bispecific BiTE antibody cross-reactive with non-human primate antigens. Molecular Cancer Therapeutics, 11(12): 2664-2673 (2002).
Moisini et al., BAFF: a local and system target in autoimmune disease. Clin Exp Immunol., 158:155-63 (2009).
Ngo et al., Computational complexity, protein structure prediction, and the Levinthal paradox. The Protein Folding Problem and Tertiary Structure Prediction, 492-495 (1994).
Novak et al., Expression of BCMA, TACI, and BAFF-R in multiple myeloma: a mechanism for growth and survival. Blood, 103: 689-94 (2004).
Paul, William E., Fundamental Immunology, 3rd Edition, Raven Press, New York, Chapt. 8, pp. 292-295.
Pelletier et al. Comparison of soluble decoy IgG fusion proteins of BAFF-R and BCMA as antagonists for BAFF. J Biol Chem., 278( 35): 33127-33133, 2003.
Rennert et al. A soluble form of B Cell maturaion factor antigen, a receptor for the tumor necrosis factor family member APRIL, inhibits tumor cell growth. J. Exp. Med., 192(11): 1677-1683,2000.
Rudikoff et al., Single amino acid substitution altering antigen-binding specificity. Proc. Natl. Acad. Sci. USA 79: 1979-1983 (1982).
Rudnick et al., Affinity and avidity in antibody-based tumor targeting. Cancer Biotherapy and Radio Pharmaceuticals, 24(2): 155-61 (2009).
Ryan et al. Antibody targeting of B-cell maturation factor antigen on malignant plasma cells, Mol. Cancer Ther., 6(11): 3009-18 (2007).
Schliemann et al., An essential role for BAFF in the normal development of B cells through a BCMA-independent pathway. Science, 293(5537): 2111-4 (2001).
Sewell et al., 319 Ant-PSMA X Anti-CD3 Bispecific Antibody Efficiently Redirects T Cell Cytotoxicity in Castrate-resistant prostate cancer models. European Journal of Cancer, Elsevier, Amsterdam, NL, 48(6): 98 (2012).
Skolnick et al. From genes to protein structure and function: novel applications of computational approaches in the genomic era. Trends in Biotech., 18(1): 34-39 (2000).
Smith et al. The challenges of genome sequence annotation or "The devil is in the details". Nature Biotech., 15: 1222-23 1997.
Smith-Gill et al., Contributions of immunoglobulin heavy and light chains to antibody specificity for lysozyme and two haptens. J. Immunol. 139:4135-44 (1987).
Song et al. Light chain of natural antibody plays a dominant role in protein antigen binding. Biochem. Biophys. Res. Comm. 268:390-94 (2000).
Sutherland et al. Targeting BAFF: immunomodulation for autoimmune diseases and lymphomas. Pharmacol Ther. 112: 774-786 (2006).
Tai et al. Targeting B-cell maturation factor antigen in multiple myeloma. Immunother., 7(11): 1187-1199 (2015).
Thurber et al., Antibody tumor penetration: Transport opposed by systemic and antigen-mediated clearance. Adv. Drug Deily. Rev. 60: 1421-34 (2008).
Tokuriki et al. Stability effects of mutations and protein evolvability. Curr. Opin. Structural. Biol. 19: 596-604 (2009).
Wells. J.A. Additivity of mutational effects in proteins. Biochemistry 29 (37): 8509-8517 (1990).
Wu et al., Humanization of a murine monoclonal antibody by simultaneous optimization of framework and CDR residues. J. Mol. Biol. 294: 151-62 (1999).
Kuo et al., Engineering a CD123xCD3 bispecific scFv immunofusion for the treatment of leukemia and elimination of leukemia stem cells, Protein Eng. Des. Sel., 25(10):561-70 (2012).

* cited by examiner d) Bispecific human albumin fusion construct c) Bispecific X-body construct ● = Charge pairing sites

Donor 1

Donor 2

Donor 3

PSMA AND CD3 BISPECIFIC T CELL ENGAGING ANTIBODY CONSTRUCTS

This application includes a sequence listing submitted electronically as text file 50402A SubSeqlisting2.txt (Size: 1,564,918 bytes: Created: Oct. 17, 2019) and is incorporated herein by reference.

BACKGROUND

Bispecific antibody derived molecules such as BiTE® (bispecific T cell engager) antibody constructs are recombinant protein constructs made from two flexibly linked antibody derived binding domains. One binding domain of BiTE® antibody constructs is specific for a selected tumor-associated surface antigen on target cells; the second binding domain is specific for CD3, a subunit of the T cell receptor complex on T cells. By their particular design, BiTE® antibody constructs are uniquely suited to transiently connect T cells with target cells and, at the same time, potently activate the inherent cytolytic potential of T cells against target cells. An important further development of the first generation of BiTE® antibody constructs (see WO 99/54440 and WO 2005/040220) developed into the clinic as AMG 103 and AMG 110 was the provision of bispecific antibody constructs binding to a context independent epitope at the N-terminus of the CD3ε chain (WO 2008/119567). BiTE® antibody constructs binding to this elected epitope do not only show cross-species specificity for the human and the *Callithrix jacchus*, *Saguinus oedipus* or *Saimiri sciureus* CD3ε chain, but also, due to recognizing this specific epitope (instead of previously described epitopes of CD3 binders in bispecific T cell engaging molecules), do not unspecifically activate T cells to the same degree as observed for the previous generation of T cell engaging antibodies. This reduction in T cell activation was connected is correlated with less or reduced T cell redistribution in patients, the latter being identified as a risk for side effects.

Antibody constructs as described in WO 2008/119567 are likely to suffer from rapid clearance from the body; thus, while they are able to reach most parts of the body rapidly, and are quick to produce and easier to handle, their in vivo applications may be limited by their brief persistence in vivo. Prolonged administration by continuous intravenous infusion was used to achieve therapeutic effects because of the short in vivo half-life of this small, single chain molecule. However, such continuous intravenous infusions are classified as inconvenient for the patients and, thus, in case of more convenient alternative treatment approaches, hamper the election of the compound demonstrated to be more efficient in the treatment of the respective disease. Hence, there is a need in the art for bispecific therapeutics that retain similar therapeutic efficacy, that have a format which is straightforward to produce, and that have favorable pharmacokinetic properties, including a longer half-life.

An increased half-life is generally useful in in vivo applications of immunoglobulins, especially antibodies and most especially antibody fragments of small size. Approaches described in the art to achieve such effect comprise the fusion of the small bispecific antibody construct to larger proteins, which preferably do not interfere with the therapeutic effect of the BiTE®. Examples for such further developments of bispecific T cell engagers comprise bispecifc Fc-molecules e.g. described in US 2014/0302037, US 2014/0308285, WO 2014/144722, WO 2014/151910 and WO 2015/048272. An alternative strategy is the use of HSA fused to the bispecific molecule or the mere fusion of human albumin binding peptides (see e.g. WO2013/128027, WO2014/140358).

Several markers for prostate cancer have been identified, including e.g. prostate-specific antigen (PSA), the six-transmembrane epithelial antigen of the prostate (STEAP) (Hubert et al., PNAS 96 (1999), 14523-14528), the prostate stem cell antigen (PSCA) (Reiter et al., Proc. Nat. Acad. Sci. 95: 1735-1740, 1998) and the prostate-specific membrane antigen (PSMA; PSM) (Israeli et al., Cancer Res. 53 (1993). PSMA was originally defined by the monoclonal antibody (MAb) 7E11 derived from immunization with a partially purified membrane preparation from the lymph node prostatic adenocarcinoma (LNCaP) cell line (Horoszewicz et al., Anticancer Res. 7 (1987), 927-35). A 2.65-kb cDNA fragment encoding the PSMA protein was cloned and subsequently mapped to chromosome 11p11.2 (Israeli et al., loc. cit.; O'Keefe et al., Biochem. Biophys. Acta 1443 (1998), 113-127). Initial analysis of PSMA demonstrated widespread expression within the cells of the prostatic secretory epithelium. Immunohistochemical staining demonstrated that PSMA was absent to moderately expressed in hyperplastic and benign tissues, while malignant tissues stained with the greatest intensity (Horoszewicz et al., loc. cit.). Subsequent investigations have recapitulated these results and evinced PSMA expression as a universal feature in practically every prostatic tissue examined to date. These reports further demonstrate that expression of PSMA increases precipitously proportional to tumor aggressiveness (Burger et al., Int. J. Cancer 100 (2002), 228-237; Chang et al., Cancer Res. 59 (1999), 3192-98; Chang et al., Urology 57 (2001), 1179-83), Kawakami and Nakayama, Cancer Res. 57 (1997), 2321-24; Liu et al., Cancer Res. 57 (1997), 3629-34; Lopes et al., Cancer Res. 50 (1990), 6423-29; Silver et al., Clin. Cancer Res. 9 (2003), 6357-62; Sweat et al., Urology 52 (1998), 637-40; Troyer et al., Int. J. Cancer 62 (1995), 552-558; Wright et al., Urology 48 (1996), 326-334). Consistent with the correlation between PSMA expression and tumor stage, increased levels of PSMA are associated with androgen-independent prostate cancer (PCa). Analysis of tissue samples from patients with prostate cancer has demonstrated elevated PSMA levels after physical castration or androgen-deprivation therapy. Unlike expression of prostate specific antigen, which is downregulated after androgen ablation, PSMA expression is significantly increased in both primary and metastatic tumor specimens (Kawakami et al., Wright et al., loc. cit.). Consistent with the elevated expression in androgen-independent tumors, PSMA transcription is also known to be downregulated by steroids, and administration of testosterone mediates a dramatic reduction in PSMA protein and mRNA levels (Israeli et al., Cancer Res. 54 (1994), 1807-11; Wright et al., loc. cit.). PSMA is also highly expressed in secondary prostatic tumors and occult metastatic disease. Immunohistochemical analysis has revealed relatively intense and homogeneous expression of PSMA within metastatic lesions localized to lymph nodes, bone, soft tissue, and lungs compared with benign prostatic tissues (Chang et al. (2001), loc. cit.; Murphy et al., Cancer 78 (1996), 809-818; Sweat et al., loc. cit.). Some reports have also indicated limited PSMA expression in extraprostatic tissues, including a subset of renal proximal tubules, some cells of the intestinal brush-border membrane, and rare cells in the colonic crypts (Chang et al. (1999), Horoszewicz et al., Israeli et al. (1994), Lopes et al., Troyer et al., loc. cit.). However, the levels of PSMA in these tissues are generally two to three orders of magnitude less than those observed in the prostate (Sokoloff et al., Prostate 43 (2000), 150-157). PSMA is also expressed in the tumor-associated neovasculature of most solid cancers examined yet is absent in the normal vascular endothelium (Chang et al. (1999), Liu et al., Silver et al., loc. cit.). Although the significance of PSMA expression within the vasculature is unknown, the specificity for tumor-associated endothelium makes PSMA a potential target for the treatment of many forms of malignancy.

SUMMARY

All the half-life extending formats (HLE formats) of bispecific T cell engaging molecules described in the art, which included the hetero Fc (also designated as heterodimeric Fc, hetFc or hFc) format and the fusion of human serum albumin (also designated as HSA or hALB) had individual disadvantages such as unspecific T cell activation, complement activation, instability, or a pharmacokinetic profile which does not meet the desired half-life prolongation of the molecules. It is thus the object of the present invention to provide a half-life extending format of bispecific T cell engaging molecules, which overcomes at least one and, of course, preferably more than one of these individual defects observed for the state of the art molecules. Accordingly, the present invention provides antibody constructs of a specific Fc modality characterized by comprising a first domain binding to PSMA, a second domain binding to an extracellular epitope of the human and the *Macaca* CD3ε chain, and a third domain, which is the specific Fc modality. Moreover, the invention provides a polynucleotide encoding the antibody construct, a vector comprising this polynucleotide, host cells expressing the construct and a pharmaceutical composition comprising the same.

DESCRIPTION OF THE FIGURES

FIG. 1A shows a diagram of one embodiment of an antibody construct of the invention. FIG. 1B shows a heterodimeric Fc antibody construct and FIG. 1C shows a X-body construct described in the art. The indicated charged pairs are introduced in order to enforce the heterodimerization. FIG. 1D shows the fusion of an antibody construct with a human serum albumin (HSA/hALB).

FIG. 2A—antibody construct of the invention in a 48 h activation assay with human PBMC (3×); HLE BiTE® serial dilutions (start 20 nM; 1:5, 7×+blank); w/o or with FcR blocking [10 mg/mL huIgG (Kiovog, Baxter)]; FACS measurement of CD69 and CD25 [not shown] expression on CD4$^+$, CD8$^+$ T cells. FIG. 2B—Hetero-Fc antibody construct in 48 h activation assay with human PBMC and CD14$^+$/CD33$^+$ cell depleted PBMC (3×); HLE BiTE® serial dilutions (start 20 nM; 1:5, 7×+blank); FACS measurement of CD69 and CD25 [not shown] expression on CD4$^+$, CD8$^+$ T cells.

FIG. 3A—antibody construct of the invention in a 48 h activation assay with human PBMC (3×); HLE BiTE® serial dilutions (start 20 nM; 1:5, 7×+blank); w/o or with FcR blocking [10 mg/mL huIgG (Kiovog, Baxter)]; FACS measurement of CD69 and CD25 [not shown] expression on CD4$^+$, CD8$^+$ T cells. FIG. 3B—Hetero-Fc antibody construct in a 48 h activation assay with human PBMC and CD14$^+$/CD33$^+$ cell depleted PBMC (3×); HLE BiTE® serial dilutions (start 20 nM; 1:5, 7×+blank); FACS measurement of CD69 and CD25 [not shown] expression on CD4$^+$, CD8$^+$ T cells. FIG. 3C—X-body construct in a 48 h activation assay with human PBMC and CD14$^+$/CD33$^+$ cell depleted PBMC (3×); HLE BiTE® serial dilutions (start 20 nM; 1:5, 7×+blank); FACS measurement of CD69 and CD25 [not shown] expression on CD4$^+$, CD8$^+$ T cells. FIGS. 3D-4F—Isolated PBMC from three different healthy human donors were cultured with increasing concentrations of HLE bispecific antibody constructs specific for Target B antigens for 48 h. The expression of the activation marker CD69 on CD4+ and CD8+ T cells was determined by flow cytometric analysis using a PE-Cy7 conjugated mab specific for CD69.

FIG. 4: Complement C1q Binding of BiTE® Fc fusion antibody constructs. BiTE® Fc fusion antibody constructs (BiTE® single chain Fc (triangle), BiTE® hetero Fc (squares), canonical BiTE® (circle)) were coated on a Maxisorp plate (in dilution series), prior to incubation with pooled human serum and incubation with polyclonal anti-human CC1q murine antibody, visualized by goat anti-mouse Fc-AP conjugate.

DETAILED DESCRIPTION

Figure 1B:
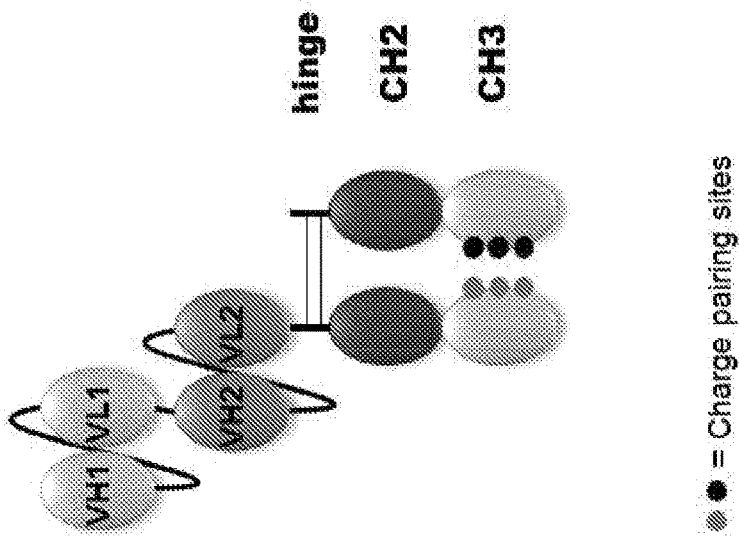
FIGS. 1A-1D.
Figure 1A:
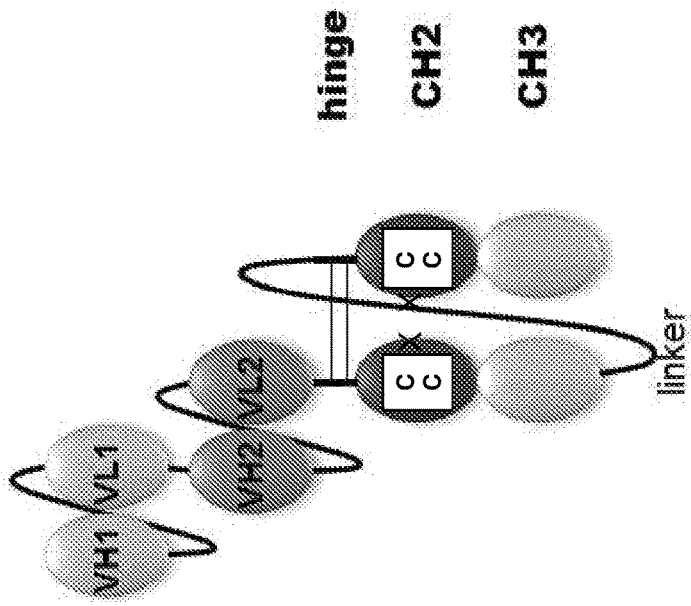
Figure 1D:
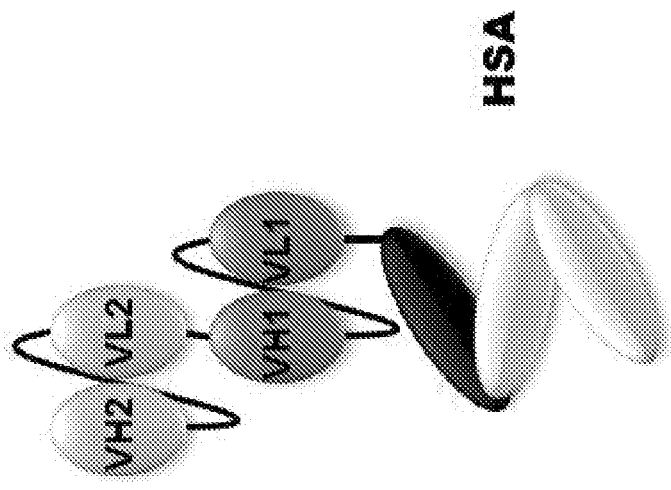
Figure 1C:
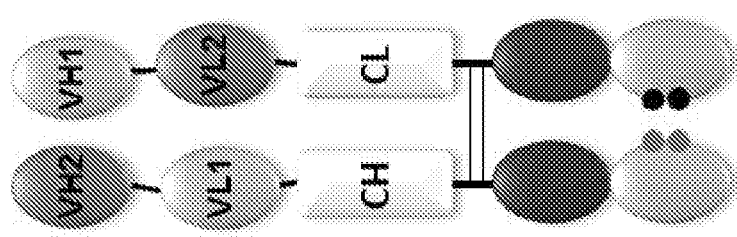

In addition to the significantly prolonged half-life of antibody constructs of the invention, which are preferably bispecific, the fusion of the specific Fc modality, i.e., the third domain according to the present invention, is responsible for a surprising significant impact on the first and second binding domain of the antibody construct of the invention. Thus, while other half-life extending modalities of T cell engaging antibody constructs show individual preferred features, the election of the present specific Fc modality allows for the provision of bispecific molecules which typically show a broad spectrum of preferred characteristics of a robust molecular format and, thus, allow for the development of promising pharmaceutical compositions.

Thus, the present invention provides an antibody construct comprising:
- a first domain which binds to PSMA,
- a second domain which binds to an extracellular epitope of the human and the *Macaca* CD3ε chain; and
- a third domain which comprises two polypeptide monomers, each comprising a hinge, a CH2 domain and a CH3 domain, wherein said two polypeptide monomers are fused to each other via a peptide linker.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen and/or is/are drawn from the variable heavy chain (VH) and/or variable light chain (VL) domains of an antibody or fragment thereof. Furthermore, the binding domain of an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. An alternative approach to define the minimal structure requirements of an antibody is the definition of the epitope of the antibody within the structure of the specific target, respectively, the protein domain of the target protein composing the epitope region (epitope cluster) or by reference to an specific antibody competing with the epitope of the defined antibody. The antibodies on which the constructs according to the invention are based include for example monoclonal, recombinant, chimeric, deimmunized, humanized and human antibodies.

The binding domain of an antibody construct according to the invention may e.g. comprise the above referred groups of CDRs. Preferably, those CDRs are comprised in the framework of an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')$_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Also within the definition of "binding domain" or "domain which binds" are fragments of full-length antibodies, such as VH, VHH, VL, (s)dAb, Fv, Fd, Fab, Fab', F(ab')2 or "r IgG" ("half antibody"). Antibody constructs according to the invention may also comprise modified fragments of antibodies, also called antibody variants, such as scFv, di-scFv or bi(s)-scFv, scFv-Fc, scFv-zipper, scFab, Fab$_2$, Fab$_3$, diabodies, single chain diabodies, tandem diabodies (Tandab's), tandem di-scFv, tandem tri-scFv, "multibodies" such as triabodies or tetrabodies, and single domain antibodies such as nanobodies or single variable domain antibodies comprising merely one variable domain, which may be VHH, VH or VL, that specifically bind an antigen or epitope independently of other V regions or domains.

As used herein, the terms "single-chain Fv," "single-chain antibodies" or "scFv" refer to single polypeptide chain antibody fragments that comprise the variable regions from both the heavy and light chains, but lack the constant regions. Generally, a single-chain antibody further comprises a polypeptide linker between the VH and VL domains which enables it to form the desired structure which would allow for antigen binding. Single chain antibodies are discussed in detail by Pluckthun in The Pharmacology of Monoclonal Antibodies, vol. 113, Rosenburg and Moore eds. Springer-Verlag, New York, pp. 269-315 (1994). Various methods of generating single chain antibodies are known, including those described in U.S. Pat. Nos. 4,694,778 and 5,260,203; International Patent Application Publication No. WO 88/01649; Bird (1988) Science 242:423-442; Huston et al. (1988) Proc. Natl. Acad. Sci. USA 85:5879-5883; Ward et al. (1989) Nature 334:54454; Skerra et al. (1988) Science 242:1038-1041. In specific embodiments, single-chain antibodies can also be bispecific, multispecific, human, and/or humanized and/or synthetic.

Furthermore, the definition of the term "antibody construct" includes monovalent, bivalent and polyvalent/multivalent constructs and, thus, bispecific constructs, specifically binding to only two antigenic structure, as well as polyspecific/multispecific constructs, which specifically bind more than two antigenic structures, e.g. three, four or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The term "bispecific" as used herein refers to an antibody construct which is "at least bispecific", i.e., it comprises at least a first binding domain and a second binding domain, wherein the first binding domain binds to one antigen or target (here: PSMA), and the second binding domain binds to another antigen or target (here: CD3). Accordingly, antibody constructs according to the invention comprise specificities for at least two different antigens or targets. For example, the first domain does preferably not bind to an extracellular epitope of CD3☐ of one or more of the species as described herein. The term "target cell surface antigen" refers to an antigenic structure expressed by a cell and which is present at the cell surface such that it is accessible for an antibody construct as described herein. It may be a protein, preferably the extracellular portion of a protein, or a carbohydrate structure, preferably a carbohydrate structure of a protein, such as a glycoprotein. It is preferably a tumor antigen. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sides with different specificities. Bispecific antibody constructs can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains (VH/VL) of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. The peptide linkers can also be used to fuse the third domain to the other domains of the antibody construct of the invention. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic side or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIACORE™ system can be used to increase the efficiency of phage antibodies which bind to an epitope of a target cell surface antigen (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetic diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e.g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sides (e.g. 6-7 sides) are mutated to generate all possible amino acid substitutions at each side. The antibody variants thus generated are displayed in a monovalent fashion from filamentous phage particles as fusions to the gene III product of M13 packaged within each particle. The phage-displayed variants are then screened for their biological activity (e.g. binding affinity) as herein disclosed. In order to identify candidate hypervariable region sides for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human PSMA. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or side-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse. Preferably, a "fully human antibody" does not include amino acid residues not encoded by human germline immunoglobulin sequences.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target side on the target molecules (antigens), here: PSMA and CD3, respectively. The structure and function of the first binding domain (recognizing PSMA), and preferably also the structure and/or function of the second binding domain (recognizing CD3), is/are based on the structure and/or function of an antibody, e.g. of a full-length or whole immunoglobulin molecule, and/or is/are drawn from the variable heavy chain (VH) and/or variable light chain (VL) domains of an antibody or fragment thereof. Preferably the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids).

The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to PSMA and/or the binding domain which binds to CD3ε is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first Xeno-Mouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs.

These results also suggested that introduction of larger portions of the human Ig loci containing greater numbers of V genes, additional regulatory elements, and human Ig constant regions may recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430,938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721,367; and 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161,739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against PSMA and a human binding domain against CD3ε in order to vitiate concerns and/or effects of HAMA or HACA response.

The terms "(specifically) binds to", "(specifically) recognizes", "is (specifically) directed to", and "(specifically) reacts with" mean in accordance with this invention that a binding domain interacts or specifically interacts with a given epitope or a given target side on the target molecules (antigens), here: PSMA and CD3E, respectively.

The term "epitope" refers to a side on an antigen to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction side". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for one of the binding domains is comprised within the target cell surface antigen protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human PSMA protein is exchanged/replaced with its corresponding region of a non-human and non-primate PSMA (e.g., mouse PSMA, but others like chicken, rat, hamster, rabbit etc. may also be conceivable), a decrease in the binding of the binding domain is expected to occur, unless the binding domain is cross-reactive for the non-human, non-primate PSMA used. Said decrease is preferably at least 10%, 20%, 30%, 40%, or 50%; more preferably at least 60%, 70%, or 80%, and most preferably 90%, 95% or even 100% in comparison to the binding to the respective region in the human PSMA protein, whereby binding to the respective region in the human PSMA protein is set to be 100%. It is envisaged that the aforementioned human PSMA/non-human PSMA chimeras are expressed in CHO cells. It is also envisaged that the human PSMA/non-human PSMA chimeras are fused with a transmembrane domain and/or cytoplasmic domain of a different membrane-bound protein such as EpCAM.

In an alternative or additional method for epitope mapping, several truncated versions of the human PSMA extracellular domain can be generated in order to determine a specific region that is recognized by a binding domain. In these truncated versions, the different extracellular PSMA domains/sub-domains or regions are stepwise deleted, starting from the N-terminus. It is envisaged that the truncated PSMA versions may be expressed in CHO cells. It is also envisaged that the truncated PSMA versions may be fused with a transmembrane domain and/or cytoplasmic domain of a different membrane-bound protein such as EpCAM. It is also envisaged that the truncated PSMA versions may encompass a signal peptide domain at their N-terminus, for example a signal peptide derived from mouse IgG heavy chain signal peptide. It is furthermore envisaged that the truncated PSMA versions may encompass a v5 domain at their N-terminus (following the signal peptide) which allows verifying their correct expression on the cell surface. A decrease or a loss of binding is expected to occur with those truncated PSMA versions which do not encompass any more the PSMA region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human PSMA protein (or its extracellular region or domain) is set to be 100.

A further method to determine the contribution of a specific residue of PSMA to the recognition by an antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: PSMA and CD3, respectively) and, generally, does not exhibit significant reactivity with proteins or antigens other than the PSMA or CD3. "Appreciable affinity" includes binding with an affinity of about $10^{-6}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than the PSMA or CD3. Preferably, a binding domain of the invention does not essentially or substantially bind to proteins or antigens other than PSMA or CD3 (i.e., the first binding domain is not capable of binding to proteins other than PSMA and the second binding domain is not capable of binding to proteins other than CD3). It is an envisaged characteristic of the antibody constructs according to the present invention to have superior affinity characteristics in comparison to other HLE formats. Such a superior affinity, in consequence, suggests a prolonged half-life in vivo. The longer half-life of the antibody constructs according to the present invention may reduce the duration and frequency of administration which typically contributes to improved patient compliance. This is of particular importance as the antibody constructs of the present invention are particularly beneficial for highly weakened or even multimorbide cancer patients.

The term "does not essentially/substantially bind" or "is not capable of binding" means that a binding domain of the present invention does not bind a protein or antigen other than the PSMA or CD3, i.e., does not show reactivity of more than 30%, preferably not more than 20%, more preferably not more than 10%, particularly preferably not more than 9%, 8%, 7%, 6% or 5% with proteins or antigens other than PSMA or CD3, whereby binding to the PSMA or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-side with its specific antigen may result in a simple binding of said side to the antigen. Moreover, the specific interaction of the antigen-interaction-side with its specific antigen may alternatively or additionally result in the initiation of a signal, e.g. due to the induction of a change of the conformation of the antigen, an oligomerization of the antigen, etc.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding side (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding side is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding side. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant ("C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "Fc portion" or "Fc monomer" means in connection with this invention a polypeptide comprising at least one domain having the function of a CH2 domain and at least one domain having the function of a CH3 domain of an immunoglobulin molecule. As apparent from the term "Fc monomer", the polypeptide comprising those CH domains is a "polypeptide monomer". An Fc monomer can be a polypeptide comprising at least a fragment of the constant region of an immunoglobulin excluding the first constant region immunoglobulin domain of the heavy chain (CH1), but maintaining at least a functional part of one CH2 domain and a functional part of one CH3 domain, wherein the CH2 domain is amino terminal to the CH3 domain. In a preferred aspect of this definition, an Fc monomer can be a polypeptide constant region comprising a portion of the Ig-Fc hinge region, a CH2 region and a CH3 region, wherein the hinge region is amino terminal to the CH2 domain. It is envisaged that the hinge region of the present invention promotes dimerization. Such Fc polypeptide molecules can be obtained by papain digestion of an immunoglobulin region (of course resulting in a dimer of two Fc polypeptide), for example and not limitation. In another aspect of this definition, an Fc monomer can be a polypeptide region comprising a portion of a CH2 region and a CH3 region. Such Fc polypeptide molecules can be obtained by pepsin digestion of an immunoglobulin molecule, for example and not limitation. In one embodiment, the polypeptide sequence of an Fc monomer is substantially similar to an Fc polypeptide sequence of: an $IgG_1$ Fc region, an $IgG_2$ Fc region, an $IgG_3$ Fc region, an $IgG_4$ Fc region, an IgM Fc region, an IgA Fc region, an IgD Fc region and an IgE Fc region. (See, e.g., Padlan, Molecular Immunology, 31(3), 169-217 (1993)). Because there is some variation between immunoglobulins, and solely for clarity, Fc monomer refers to the last two heavy chain constant region immunoglobulin domains of IgA, IgD, and IgG, and the last three heavy chain constant region immunoglobulin domains of IgE and IgM. As mentioned, the Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion may vary an example for a human IgG heavy chain Fc portion comprising a functional hinge, CH2 and CH3 domain can be defined e.g. to comprise residues D231 (of the hinge domain—corresponding to D234 in Table 1 below) to P476, respectively L476 (for $IgG_4$) of the carboxyl-terminus of the CH3 domain, wherein the numbering is according to Kabat. The two Fc portion or Fc monomer, which are fused to each other via a peptide linker define the third domain of the antibody construct of the invention, which may also be defined as scFc domain.

In one embodiment of the invention it is envisaged that a scFc domain as disclosed herein (see, e.g., any one of SEQ ID NOs: 25-32 at Table 38), respectively the Fc monomers (e.g., any one of SEQ ID NOs: 17-24 at Table 38) fused to each other are comprised only in the third domain of the antibody construct.

In line with the present invention an IgG hinge region can be identified by analogy using the Kabat numbering as set forth in Table 1. In line with the above, the minimal requirement it is envisaged that for a hinge domain/region of the present invention in line with the present invention are comprises the amino acid residues corresponding to the IgG1 sequence stretch of D231 D234 to P243 according to the Kabat numbering. It is likewise envisaged that a hinge domain/region of the present invention comprises or consists of the IgG1 hinge sequence DKTHTCPPCP (SEQ ID NO: 477) (corresponding to the stretch D234 to P243 as shown in Table 1 below—variations of said sequence are also envisaged provided that the hinge region still promotes dimerization). In a preferred embodiment of the invention the glycosylation site at Kabat position 314 of the CH2 domains in the third domain of the antibody construct is removed by a N314X substitution, wherein X is any amino acid excluding Q. Said substitution is preferably a N314G substitution. In a more preferred embodiment, said CH2 domain additionally comprises the following substitutions (position according to Kabat) V321C and R309O (these substitutions introduce the intra domain cysteine disulfide bridge at Kabat positions 309 and 321).

It is also envisaged that the third domain of the antibody construct of the invention comprises or consists in an amino to carboxyl order: DKTHTCPPCP (SEQ ID NO: 477) (i.e. hinge) —CH2-CH3-linker-DKTHTCPPCP (SEQ ID NO: 477) (i.e. hinge) —CH2-CH3. The peptide linker of the aforementioned antibody construct is in a preferred embodiment characterized by the amino acid sequence Gly-Gly-Gly-Gly-Ser, i.e. Gly4Ser (SEQ ID NO: 1), or polymers thereof, i.e. (Gly4Ser)x, where x is an integer of 5 or greater (e.g. 5, 6, 7, 8 etc. or greater), 6 being preferred ((Gly4Ser) 6). Said construct may further comprise the aforementioned substitutions N314X, preferably N314G, and/or the further substitutions V321C and R309O. In a preferred embodiment of the antibody constructs of the invention as defined herein before, it is envisaged that the second domain binds to an extracellular epitope of the human and/or the *Macaca* CD3ϵ chain.

TABLE 1

Kabat numbering of the amino acid residues of the hinge region

| IMGT numbering for the hinge | IgG$_1$ amino acid translation | Kabat numbering |
|---|---|---|
| 1 | (E) | 226 |
| 2 | P | 227 |
| 3 | K | 228 |
| 4 | S | 232 |
| 5 | C | 233 |
| 6 | D | 234 |
| 7 | K | 235 |
| 8 | T | 236 |
| 9 | H | 237 |
| 10 | T | 238 |
| 11 | C | 239 |
| 12 | P | 240 |
| 13 | P | 241 |
| 14 | C | 242 |
| 15 | P | 243 |

In further embodiments of the present invention, the hinge domain/region comprises or consists of the IgG2 subtype hinge sequence ERKCCVECPPCP (SEQ ID NO: 478), the IgG3 subtype hinge sequence ELKTPLDTTHTCPRCP (SEQ ID NO: 479) or ELKTPLGDTTHTCPRCP (SEQ ID NO: 486), and/or the IgG4 subtype hinge sequence ESKYGPPCPSCP (SEQ ID NO: 480). The IgG1 subtype hinge sequence may be the following one EPKSCDKTHTCPPCP (as shown in Table 1 and SEQ ID NO: 487). These core hinge regions are thus also envisaged in the context of the present invention.

The location and sequence of the IgG CH2 and IgG CD3 domain can be identified by analogy using the Kabat numbering as set forth in Table 2:

TABLE 2

Kabat numbering of the amino acid residues of the IgG CH2 and CH3 region

| IgG subtype | CH2 aa translation | CH2 Kabat numbering | CH3 aa translation | CH3 Kabat numbering |
|---|---|---|---|---|
| IgG$_1$ | AP*E* . . . *KA*K | 244 . . . 360 | GQP . . . *P*GK | 361 . . . 478 |
| IgG$_2$ | AP*P* . . . *KT*K | 244 . . . 360 | GQP . . . *P*GK | 361 . . . 478 |

TABLE 2-continued

Kabat numbering of the amino acid residues of the IgG CH2 and CH3 region

| IgG subtype | CH2 aa translation | CH2 Kabat numbering | CH3 aa translation | CH3 Kabat numbering |
|---|---|---|---|---|
| IgG$_3$ | AP*E* . . . *KT*K | 244 . . . 360 | GQP . . . *P*GK | 361 . . . 478 |
| IgG$_4$ | AP*E* . . . *KA*K | 244 . . . 360 | GQP . . . *L*GK | 361 . . . 478 |

In one embodiment of the invention the emphasized bold amino acid residues in the CH3 domain of the first or both Fc monomers are deleted.

The peptide linker, by whom the polypeptide monomers ("Fc portion" or "Fc monomer") of the third domain are fused to each other, preferably comprises at least 25 amino acid residues (25, 26, 27, 28, 29, 30 etc.). More preferably, this peptide linker comprises at least 30 amino acid residues (30, 31, 32, 33, 34, 35 etc.). It is also preferred that the linker comprises up to 40 amino acid residues, more preferably up to 35 amino acid residues, most preferably exactly 30 amino acid residues. A preferred embodiment of such peptide linker is characterized by the amino acid sequence Gly-Gly-Gly-Gly-Ser, i.e. Gly$_4$Ser (SEQ ID NO: 1), or polymers thereof, i.e. (Gly$_4$Ser)x, where x is an integer of 5 or greater (e.g. 6, 7 or 8). Preferably the integer is 6 or 7, more preferably the integer is 6.

In the event that a linker is used to fuse the first domain to the second domain, or the first or second domain to the third domain, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A preferred embodiment of the peptide linker for a fusion the first and the second domain is depicted in SEQ ID NO:1. A preferred linker embodiment of the peptide linker for fusing the second and the third domain is a (Gly)$_4$-linker, also called G$_4$-linker.

A particularly preferred "single" amino acid in the context of one of the above described "peptide linker" is Gly. Accordingly, said peptide linker may consist of the single amino acid Gly. In a preferred embodiment of the invention a peptide linker is characterized by the amino acid sequence Gly-Gly-Gly-Gly-Ser, i.e. Gly$_4$Ser (SEQ ID NO: 1), or polymers thereof, i.e. (Gly$_4$Ser)x, where x is an integer of 1 or greater (e.g. 2 or 3). Preferred linkers are depicted in SEQ ID NOs: 1 to 12. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, N.Y., 2001).

In a preferred embodiment of the antibody construct or the present invention the first and second domain form an antibody construct in a format selected from the group consisting of (scFv)$_2$, scFv-single domain mAb, diabody and oligomers of any of the those formats.

According to a particularly preferred embodiment, and as documented in the appended examples, the first and the second domain of the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain antibody constructs are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)$_2$ can be engineered by linking two scFv molecules (e.g. with linkers as described hereinbefore). If these two scFv molecules have the same binding specificity, the resulting (scFv)$_2$ molecule will preferably be called bivalent (i.e. it has two valences for the same target epitope). If the two scFv molecules have different binding specificities, the resulting (scFv)$_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8).

In line with this invention either the first, the second or the first and the second domain may comprise a single domain antibody, respectively the variable domain or at least the CDRs of a single domain antibody. Single domain antibodies comprise merely one (monomeric) antibody variable domain which is able to bind selectively to a specific antigen, independently of other V regions or domains. The first single domain antibodies were engineered from heavy chain antibodies found in camelids, and these are called V$_H$H fragments. Cartilaginous fishes also have heavy chain antibodies (IgNAR) from which single domain antibodies called V$_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)$_2$ is hence a monoclonal antibody construct composed of (at least) two single domain monoclonal antibodies, which are individually selected from the group comprising V$_H$, V$_L$, V$_H$H and V$_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Possible means for the read-out includes flow cytometry.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (a) and beta (13) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors.

The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3ε gene which resides on chromosome 11. The most preferred epitope of CD3 epsilon is comprised within amino acid residues 1-27 of the human CD3 epsilon extracellular domain. It is envisaged that antibody constructs according to the present invention typically and advantageously show less unspecific T cell activation, which is not desired in specific immunotherapy. This translates to a reduced risk of side effects.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by antibody constructs of the invention can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque PSMA which is bound by the first domain, the effector cells should also be of macaque origin such as a macaque T cell line, e.g. 4119LnPx. The target cells should express (at least the extracellular domain of) PSMA, e.g. human or macaque PSMA. Target cells can be a cell line (such as CHO) which is stably or transiently transfected with PSMA, e.g. human or macaque PSMA. Usually $EC_{50}$ values are expected to be lower with target cell lines expressing higher levels of PSMA on the cell surface. The effector to target cell (E:T) ratio is usually about 10:1, but can also vary. Cytotoxic activity of PSMA×CD3 bispecific antibody constructs can be measured in a $^{51}$Cr-release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by PSMA×CD3 bispecific antibody constructs of the present invention is preferably measured in a cell-based cytotoxicity assay. It may also be measured in a $^{51}$Cr-release assay. It is represented by the $EC_{50}$ value, which corresponds to the half maximal effective concentration (concentration of the antibody construct which induces a cytotoxic response halfway between the baseline and maximum). Preferably, the $EC_{50}$ value of the PSMA×CD3 bispecific antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤0 pM, and most preferably ≤5 pM.

The above given $EC_{50}$ values can be measured in different assays. The skilled person is aware that an $EC_{50}$ value can be expected to be lower when stimulated/enriched CD8$^+$ T cells are used as effector cells, compared with unstimulated PBMC. It can furthermore be expected that the $EC_{50}$ values are lower when the target cells express a high number of PSMA compared with a low target expression rat. For example, when stimulated/enriched human CD8$^+$ T cells are used as effector cells (and either PSMA transfected cells such as CHO cells or PSMA positive human cell lines are used as target cells), the $EC_{50}$ value of the PSMA×CD3 bispecific antibody construct is preferably ≤1000 pM, more preferably ≤500 pM, even more preferably ≤250 pM, even more preferably ≤100 pM, even more preferably ≤50 pM, even more preferably ≤10 pM, and most preferably ≤5 pM. When human PBMCs are used as effector cells, the $EC_{50}$ value of the PSMA×CD3 bispecific antibody construct is preferably ≤5000 pM or ≤4000 pM (in particular when the target cells are PSMA positive human cell lines), more preferably ≤2000 pM (in particular when the target cells are PSMA transfected cells such as CHO cells), more preferably ≤1000 pM or ≤500 pM, even more preferably ≤200 pM, even more preferably ≤150 pM, even more preferably ≤100 pM, and most preferably ≤50 pM, or lower. When a macaque T cell line such as LnPx4119 is used as effector cells, and a macaque PSMA transfected cell line such as CHO cells is used as target cell line, the $EC_{50}$ value of the PSMA×CD3 bispecific antibody construct is preferably ≤2000 pM or ≤1500 pM, more preferably ≤1000 pM or ≤500 pM, even more preferably ≤300 pM or ≤250 pM, even more preferably ≤100 pM, and most preferably ≤50 pM.

Preferably, the PSMA×CD3 bispecific antibody constructs of the present invention do not induce/mediate lysis or do not essentially induce/mediate lysis of PSMA negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of PSMA negative cells, whereby lysis of a PSMA positive human cell line is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual PSMA×CD3 bispecific antibody constructs is referred to as "potency gap". This potency gap can e.g. be calculated as ratio between $EC_{50}$ values of the molecule's monomeric and dimeric form. Potency gaps of the PSMA×CD3 bispecific antibody constructs of the present invention are preferably ≤5, more preferably ≤4, even more preferably ≤3, even more preferably ≤2 and most preferably ≤1.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human PSMA and human CD3, respectively, will also bind to PSMA/CD3 of primates including (but not limited to) new world primates (such as *Callithrix jacchus, Saguinus Oedipus* or *Saimiri sciureus*), old world primates (such baboons and macaques), gibbons, and non-human homininae.

In one embodiment of the antibody construct of the invention the first domain binds to human PSMA and further binds to macaque PSMA, such as PSMA of *Macaca fascicularis*, and more preferably, to macaque PSMA expressed on the surface macaque cells. The affinity of the first domain for PSMA, preferably for human PSMA, is preferably ≤100 nM or ≤50 nM, more preferably ≤25 nM or ≤20 nM, more preferably ≤15 nM or ≤0 nM, even more preferably ≤5 nM, even more preferably ≤2.5 nM or ≤2 nM, even more preferably nM, even more preferably ≤0.6 nM, even more preferably ≤0.5 nM, and most preferably ≤0.4 nM. The affinity can be measured for example in a BIACORE™ assay or in a Scatchard assay. Other methods of determining the affinity are also well-known to the skilled person. The affinity of the first domain for macaque PSMA is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque PSMA versus human PSMA [ma PSMA: hu PSMA] (as determined e.g. by BIACORE™ or by Scatchard analysis) is <100, preferably <20, more preferably <15, further preferably <10, even more preferably <8, more preferably <6 and most preferably <2. Preferred ranges for the affinity gap of the antibody constructs according to the invention for binding macaque PSMA versus human PSMA are between 0.1 and 20, more preferably between 0.2 and 10, even more preferably between 0.3 and 6, even more preferably between 0.5 and 3 or between 0.5 and 2.5, and most preferably between 0.5 and 2 or between 0.6 and 2.

The second domain of the antibody construct of the invention binds to human CD3 epsilon and/or to *Macaca* CD3 epsilon. In a preferred embodiment the second domain further binds to *Callithrix jacchus, Saguinus Oedipus* or *Saimiri sciureus* CD3 epsilon. *Callithrix jacchus* and *Saguinus oedipus* are both new world primate belonging to the family of Callitrichidae, while *Saimiri sciureus* is a new world primate belonging to the family of Cebidae.

It is preferred for the antibody construct of the present invention that the second domain which binds to an extracellular epitope of the human and/or the *Macaca* CD3 epsilon chain comprises a VL region comprising CDR-L1, CDR-L2 and CDR-L3 selected from:
(a) CDR-L1 as depicted in SEQ ID NO: 27 of WO 2008/119567 (SEQ ID NO: 508 herein), CDR-L2 as depicted in SEQ ID NO: 28 of WO 2008/119567 (SEQ ID NO: 509 herein) and CDR-L3 as depicted in SEQ ID NO: 29 of WO 2008/119567 (SEQ ID NO: 510 herein);
(b) CDR-L1 as depicted in SEQ ID NO: 117 of WO 2008/119567 (SEQ ID NO: 511 herein), CDR-L2 as depicted in SEQ ID NO: 118 of WO 2008/119567 (SEQ ID NO: 512 herein) and CDR-L3 as depicted in SEQ ID NO: 119 of WO 2008/119567 (SEQ ID NO: 513 herein); and
(c) CDR-L1 as depicted in SEQ ID NO: 153 of WO 2008/119567 (SEQ ID NO: 514 herein), CDR-L2 as depicted in SEQ ID NO: 154 of WO 2008/119567 (SEQ ID NO: 515 herein) and CDR-L3 as depicted in SEQ ID NO: 155 of WO 2008/119567 (SEQ ID NO: 516 herein).

In a furthermore preferred embodiment of the antibody construct of the present invention, the second domain which binds to an extracellular epitope of the human and/or the *Macaca* CD3 epsilon chain comprises a VH region comprising CDR-H 1, CDR-H2 and CDR-H3 selected from:
(a) CDR-H1 as depicted in SEQ ID NO: 12 of WO 2008/119567 (SEQ ID NO: 517 herein), CDR-H2 as depicted in SEQ ID NO: 13 of WO 2008/119567 (SEQ ID NO: 518 herein) and CDR-H3 as depicted in SEQ ID NO: 14 of WO 2008/119567 (SEQ ID NO: 519 herein);
(b) CDR-H1 as depicted in SEQ ID NO: 30 of WO 2008/119567 (SEQ ID NO: 520 herein), CDR-H2 as depicted in SEQ ID NO: 31 of WO 2008/119567 (SEQ ID NO: 521 herein) and CDR-H3 as depicted in SEQ ID NO: 32 of WO 2008/119567 (SEQ ID NO: 522 herein);
(c) CDR-H1 as depicted in SEQ ID NO: 48 of WO 2008/119567 (SEQ ID NO: 523 herein), CDR-H2 as depicted in SEQ ID NO: 49 of WO 2008/119567 (SEQ ID NO: 524 herein) and CDR-H3 as depicted in SEQ ID NO: 50 of WO 2008/119567 (SEQ ID NO: 525 herein);
(d) CDR-H1 as depicted in SEQ ID NO: 66 of WO 2008/119567 (SEQ ID NO: 526 herein), CDR-H2 as depicted in SEQ ID NO: 67 of WO 2008/119567 (SEQ ID NO: 527 herein) and CDR-H3 as depicted in SEQ ID NO: 68 of WO 2008/119567 (SEQ ID NO: 528 herein);
(e) CDR-H1 as depicted in SEQ ID NO: 84 of WO 2008/119567 (SEQ ID NO: 529 herein), CDR-H2 as depicted in SEQ ID NO: 85 of WO 2008/119567 (SEQ ID NO: 530 herein) and CDR-H3 as depicted in SEQ ID NO: 86 of WO 2008/119567 (SEQ ID NO: 531 herein);
(f) CDR-H1 as depicted in SEQ ID NO: 102 of WO 2008/119567 (SEQ ID NO: 532 herein), CDR-H2 as depicted in SEQ ID NO: 103 of WO 2008/119567 (SEQ ID NO: 533 herein) and CDR-H3 as depicted in SEQ ID NO: 104 of WO 2008/119567 (SEQ ID NO: 534 herein;
(g) CDR-H1 as depicted in SEQ ID NO: 120 of WO 2008/119567 (SEQ ID NO: 535 herein), CDR-H2 as depicted in SEQ ID NO: 121 of WO 2008/119567 (SEQ ID NO: 536 herein) and CDR-H3 as depicted in SEQ ID NO: 122 of WO 2008/119567 (SEQ ID NO: 537 herein;
(h) CDR-H1 as depicted in SEQ ID NO: 138 of WO 2008/119567 (SEQ ID NO: 538 herein), CDR-H2 as depicted in SEQ ID NO: 139 of WO 2008/119567 (SEQ ID NO: 539 herein) and CDR-H3 as depicted in SEQ ID NO: 140 of WO 2008/119567 (SEQ ID NO: 540 herein;
(i) CDR-H1 as depicted in SEQ ID NO: 156 of WO 2008/119567 (SEQ ID NO: 541 herein), CDR-H2 as depicted in SEQ ID NO: 157 of WO 2008/119567 (SEQ ID NO: 542 herein) and CDR-H3 as depicted in SEQ ID NO: 158 of WO 2008/119567 (SEQ ID NO: 543 herein); and
(j) CDR-H1 as depicted in SEQ ID NO: 174 of WO 2008/119567 (SEQ ID NO: 544 herein), CDR-H2 as depicted in SEQ ID NO: 175 of WO 2008/119567 (SEQ ID NO: 545 herein) and CDR-H3 as depicted in SEQ ID NO: 176 of WO 2008/119567 (SEQ ID NO: 546 herein).

In a preferred embodiment of the antibody construct of the invention the above described three groups of VL CDRs are combined with the above described ten groups of VH CDRs within the second binding domain to form (30) groups, each comprising CDR-L 1-3 and CDR-H 1-3.

It is preferred for the antibody construct of the present invention that the second domain which binds to CD3 comprises a VL region selected from the group consisting of those depicted in SEQ ID NOs: 17, 21, 35, 39, 53, 57, 71, 75, 89, 93, 107, 111, 125, 129, 143, 147, 161, 165, 179 or 183 of WO 2008/119567 (SEQ ID NOs: 547-566, respectively, herein) or as depicted in SEQ ID NO: 13.

It is also preferred that the second domain which binds to CD3 comprises a VH region selected from the group consisting of those depicted in SEQ ID NO: 15, 19, 33, 37, 51, 55, 69, 73, 87, 91, 105, 109, 123, 127, 141, 145, 159, 163, 177 or 181 of WO 2008/119567 WO 2008/119567 (SEQ ID NOs: 567-586, respectively, herein) or as depicted in SEQ ID NO: 14.

More preferably, the antibody construct of the present invention is characterized by a second domain which binds to CD3 comprising a VL region and a VH region selected from the group consisting of:
(a) a VL region as depicted in SEQ ID NO: 17 or 21 of WO 2008/119567 (SEQ ID NO: 547 or 548 herein) and a VH region as depicted in SEQ ID NO: 15 or 19 of WO 2008/119567 (SEQ ID NO: 567 or 568 herein);

(b) a VL region as depicted in SEQ ID NO: 35 or 39 of WO 2008/119567 (SEQ ID NO: 549 or 550 herein) and a VH region as depicted in SEQ ID NO: 33 or 37 of WO 2008/119567 (SEQ ID NO: 569 or 570 herein);
(c) a VL region as depicted in SEQ ID NO: 53 or 57 of WO 2008/119567 (SEQ ID NO: 551 or 552 herein) and a VH region as depicted in SEQ ID NO: 51 or 55 of WO 2008/119567 (SEQ ID NO: 571 or 572 herein);
(d) a VL region as depicted in SEQ ID NO: 71 or 75 of WO 2008/119567 (SEQ ID NO: 553 or 554 herein) and a VH region as depicted in SEQ ID NO: 69 or 73 of WO 2008/119567 (SEQ ID NO: 573 or 574 herein);
(e) a VL region as depicted in SEQ ID NO: 89 or 93 of WO 2008/119567 (SEQ ID NO: 555 or 556 herein) and a VH region as depicted in SEQ ID NO: 87 or 91 of WO 2008/119567 (SEQ ID NO: 575 or 576 herein);
(f) a VL region as depicted in SEQ ID NO: 107 or 111 of WO 2008/119567 (SEQ ID NO: 557 or 558 herein) and a VH region as depicted in SEQ ID NO: 105 or 109 of WO 2008/119567 (SEQ ID NO: 577 or 578 herein);
(g) a VL region as depicted in SEQ ID NO: 125 or 129 of WO 2008/119567 (SEQ ID NO: 559 or 560 herein) and a VH region as depicted in SEQ ID NO: 123 or 127 of WO 2008/119567 (SEQ ID NO: 579 or 580 herein);
(h) a VL region as depicted in SEQ ID NO: 143 or 147 of WO 2008/119567 (SEQ ID NO: 561 or 562 herein) and a VH region as depicted in SEQ ID NO: 141 or 145 of WO 2008/119567 (SEQ ID NO: 581 or 582 herein);
(i) a VL region as depicted in SEQ ID NO: 161 or 165 of WO 2008/119567 (SEQ ID NO: 563 or 564 herein) and a VH region as depicted in SEQ ID NO: 159 or 163 of WO 2008/119567 (SEQ ID NO: 583 or 584 herein); and
(j) a VL region as depicted in SEQ ID NO: 179 or 183 of WO 2008/119567 (SEQ ID NO: 565 or 566 herein) and a VH region as depicted in SEQ ID NO: 177 or 181 of WO 2008/119567 (SEQ ID NO: 585 or 586 herein).

Also preferred in connection with the antibody construct of the present invention is a second domain which binds to CD3 comprising a VL region as depicted in SEQ ID NO: 13 and a VH region as depicted in SEQ ID NO: 14.

According to a preferred embodiment of the antibody construct of the present invention, the first and/or the second domain have the following format: The pairs of VH regions and VL regions are in the format of a single chain antibody (scFv). The VH and VL regions are arranged in the order VH-VL or VL-VH. It is preferred that the VH-region is positioned N-terminally of a linker sequence, and the VL-region is positioned C-terminally of the linker sequence.

A preferred embodiment of the above described antibody construct of the present invention is characterized by the second domain which binds to CD3 comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 488-507, respectively, herein) or as depicted in SEQ ID NO: 15.

It is also envisaged that the first binding domain of the antibody construct of the invention comprises a VL region comprising CDR-L1, CDR-L2 and CDR-L3, and a VH region comprising CDR-H1, CDR-H2 and CDR-3 selected from the group consisting of:
(a) CDR-L1 as depicted in SEQ ID NO: 45, CDR-L2 as depicted in SEQ ID NO: 46, CDR-L3 as depicted in SEQ ID NO: 47, CDR-H1 as depicted in SEQ ID NO: 42, CDR-H2 as depicted in SEQ ID NO: 43, and CDR-H3 as depicted in SEQ ID NO: 44
(b) CDR-L1 as depicted in SEQ ID NO: 63, CDR-L2 as depicted in SEQ ID NO: 64, CDR-L3 as depicted in SEQ ID NO: 65, CDR-H1 as depicted in SEQ ID NO: 60, CDR-H2 as depicted in SEQ ID NO: 61, and CDR-H3 as depicted in SEQ ID NO: 62;
(c) CDR-L1 as depicted in SEQ ID NO: 81, CDR-L2 as depicted in SEQ ID NO: 82, CDR-L3 as depicted in SEQ ID NO: 83, CDR-H1 as depicted in SEQ ID NO: 78, CDR-H2 as depicted in SEQ ID NO: 79, and CDR-H3 as depicted in SEQ ID NO: 80;
(d) CDR-L1 as depicted in SEQ ID NO: 99, CDR-L2 as depicted in SEQ ID NO: 100, CDR-L3 as depicted in SEQ ID NO: 101, CDR-H1 as depicted in SEQ ID NO: 96, CDR-H2 as depicted in SEQ ID NO: 97, and CDR-H3 as depicted in SEQ ID NO: 98;
(e) CDR-L1 as depicted in SEQ ID NO: 117, CDR-L2 as depicted in SEQ ID NO: 118, CDR-L3 as depicted in SEQ ID NO: 119, CDR-H1 as depicted in SEQ ID NO: 114, CDR-H2 as depicted in SEQ ID NO: 115, and CDR-H3 as depicted in SEQ ID NO: 116;
(f) CDR-L1 as depicted in SEQ ID NO: 135, CDR-L2 as depicted in SEQ ID NO: 136, CDR-L3 as depicted in SEQ ID NO: 137, CDR-H1 as depicted in SEQ ID NO: 132, CDR-H2 as depicted in SEQ ID NO: 133, and CDR-H3 as depicted in SEQ ID NO: 134;
(g) CDR-L1 as depicted in SEQ ID NO: 153, CDR-L2 as depicted in SEQ ID NO: 154, CDR-L3 as depicted in SEQ ID NO: 155, CDR-H1 as depicted in SEQ ID NO: 150, CDR-H2 as depicted in SEQ ID NO: 151, and CDR-H3 as depicted in SEQ ID NO: 152;
(h) CDR-L1 as depicted in SEQ ID NO: 171, CDR-L2 as depicted in SEQ ID NO: 172 CDR-L3 as depicted in SEQ ID NO: 173, CDR-H1 as depicted in SEQ ID NO: 168, CDR-H2 as depicted in SEQ ID NO: 169, and CDR-H3 as depicted in SEQ ID NO: 170;
(i) CDR-L1 as depicted in SEQ ID NO: 189, CDR-L2 as depicted in SEQ ID NO: 190 CDR-L3 as depicted in SEQ ID NO: 191, CDR-H1 as depicted in SEQ ID NO: 186, CDR-H2 as depicted in SEQ ID NO: 187, and CDR-H3 as depicted in SEQ ID NO: 188;
(j) CDR-L1 as depicted in SEQ ID NO: 207, CDR-L2 as depicted in SEQ ID NO: 208 CDR-L3 as depicted in SEQ ID NO: 209, CDR-H1 as depicted in SEQ ID NO: 204, CDR-H2 as depicted in SEQ ID NO: 205, and CDR-H3 as depicted in SEQ ID NO: 206;
(k) CDR-L1 as depicted in SEQ ID NO: 225, CDR-L2 as depicted in SEQ ID NO: 226 CDR-L3 as depicted in SEQ ID NO: 227, CDR-H1 as depicted in SEQ ID NO: 222, CDR-H2 as depicted in SEQ ID NO: 223, and CDR-H3 as depicted in SEQ ID NO: 224;
(l) CDR-L1 as depicted in SEQ ID NO: 243, CDR-L2 as depicted in SEQ ID NO: 244 CDR-L3 as depicted in SEQ ID NO: 245, CDR-H1 as depicted in SEQ ID NO: 240, CDR-H2 as depicted in SEQ ID NO: 241, and CDR-H3 as depicted in SEQ ID NO: 242;
(m) CDR-L1 as depicted in SEQ ID NO: 261, CDR-L2 as depicted in SEQ ID NO: 262 CDR-L3 as depicted in SEQ ID NO: 263, CDR-H1 as depicted in SEQ ID NO: 258, CDR-H2 as depicted in SEQ ID NO: 259, and CDR-H3 as depicted in SEQ ID NO: 260;
(n) CDR-L1 as depicted in SEQ ID NO: 279, CDR-L2 as depicted in SEQ ID NO: 280 CDR-L3 as depicted in SEQ ID NO: 281, CDR-H1 as depicted in SEQ ID NO: 276, CDR-H2 as depicted in SEQ ID NO: 277, and CDR-H3 as depicted in SEQ ID NO: 278; and
(o) CDR-L1 as depicted in SEQ ID NO: 297, CDR-L2 as depicted in SEQ ID NO: 298, CDR-L3 as depicted in SEQ ID NO: 299, CDR-H1 as depicted in SEQ ID NO: 294, CDR-H2 as depicted in SEQ ID NO: 295, and CDR-H3 as depicted in SEQ ID NO: 296.
(p) CDR-L1 as depicted in SEQ ID NO: 315, CDR-L2 as depicted in SEQ ID NO: 316, CDR-L3 as depicted in SEQ ID NO: 317, CDR-H1 as depicted in SEQ ID NO: 312, CDR-H2 as depicted in SEQ ID NO: 313, and CDR-H3 as depicted in SEQ ID NO: 314.
(q) CDR-L1 as depicted in SEQ ID NO: 330, CDR-L2 as depicted in SEQ ID NO: 331, CDR-L3 as depicted in SEQ ID NO: 332, CDR-H1 as depicted in SEQ ID NO: 327, CDR-H2 as depicted in SEQ ID NO: 328, and CDR-H3 as depicted in SEQ ID NO: 329.
(r) CDR-L1 as depicted in SEQ ID NO: 345, CDR-L2 as depicted in SEQ ID NO: 346, CDR-L3 as depicted in SEQ ID NO: 347, CDR-H1 as depicted in SEQ ID NO: 342, CDR-H2 as depicted in SEQ ID NO: 343, and CDR-H3 as depicted in SEQ ID NO: 344.
(s) CDR-L1 as depicted in SEQ ID NO: 360, CDR-L2 as depicted in SEQ ID NO: 361, CDR-L3 as depicted in SEQ ID NO: 362, CDR-H1 as depicted in SEQ ID NO: 357, CDR-H2 as depicted in SEQ ID NO: 358, and CDR-H3 as depicted in SEQ ID NO: 359.
(t) CDR-L1 as depicted in SEQ ID NO: 375, CDR-L2 as depicted in SEQ ID NO: 376, CDR-L3 as depicted in SEQ ID NO: 377, CDR-H1 as depicted in SEQ ID NO: 372, CDR-H2 as depicted in SEQ ID NO: 373, and CDR-H3 as depicted in SEQ ID NO: 374.
(u) CDR-L1 as depicted in SEQ ID NO: 390, CDR-L2 as depicted in SEQ ID NO: 391, CDR-L3 as depicted in SEQ ID NO: 392, CDR-H1 as depicted in SEQ ID NO: 387, CDR-H2 as depicted in SEQ ID NO: 388, and CDR-H3 as depicted in SEQ ID NO: 389.
(v) CDR-L1 as depicted in SEQ ID NO: 405, CDR-L2 as depicted in SEQ ID NO: 406, CDR-L3 as depicted in SEQ ID NO: 407, CDR-H1 as depicted in SEQ ID NO: 402, CDR-H2 as depicted in SEQ ID NO: 403, and CDR-H3 as depicted in SEQ ID NO: 404.
(w) CDR-L1 as depicted in SEQ ID NO: 420, CDR-L2 as depicted in SEQ ID NO: 421, CDR-L3 as depicted in SEQ ID NO: 422, CDR-H1 as depicted in SEQ ID NO: 417, CDR-H2 as depicted in SEQ ID NO: 418, and CDR-H3 as depicted in SEQ ID NO: 419.
(x) CDR-L1 as depicted in SEQ ID NO: 435, CDR-L2 as depicted in SEQ ID NO: 436, CDR-L3 as depicted in SEQ ID NO: 437, CDR-H1 as depicted in SEQ ID NO: 432, CDR-H2 as depicted in SEQ ID NO: 433, and CDR-H3 as depicted in SEQ ID NO: 434.
(y) CDR-L1 as depicted in SEQ ID NO: 450, CDR-L2 as depicted in SEQ ID NO: 451, CDR-L3 as depicted in SEQ ID NO: 452, CDR-H1 as depicted in SEQ ID NO: 447, CDR-H2 as depicted in SEQ ID NO: 448, and CDR-H3 as depicted in SEQ ID NO: 449.
(z) CDR-L1 as depicted in SEQ ID NO: 465, CDR-L2 as depicted in SEQ ID NO: 466, CDR-L3 as depicted in SEQ ID NO: 467, CDR-H1 as depicted in SEQ ID NO: 462, CDR-H2 as depicted in SEQ ID NO: 463 and CDR-H3 as depicted in SEQ ID NO: 464.

It is furthermore envisaged that the first binding domain of the antibody construct of the invention comprises a VH region and a VL region selected from the group consisting of:
(a) a VH region as depicted in SEQ ID NO: 48 and a VL region as depicted in SEQ ID NO: 49;
(b) a VH region as depicted in SEQ ID NO: 66 and a VL region as depicted in SEQ ID NO: 67;
(c) a VH region as depicted in SEQ ID NO: 72 and a VL region as depicted in SEQ ID NO: 73;
(d) a VH region as depicted in SEQ ID NO: 84 and a VL region as depicted in SEQ ID NO: 85;
(e) a VH region as depicted in SEQ ID NO: 90 and a VL region as depicted in SEQ ID NO: 91;
(f) a VH region as depicted in SEQ ID NO: 102 and a VL region as depicted in SEQ ID NO: 103;
(g) a VH region as depicted in SEQ ID NO: 108 and a VL region as depicted in SEQ ID NO: 109;
(h) a VH region as depicted in SEQ ID NO: 120 and a VL region as depicted in SEQ ID NO: 121;
(i) a VH region as depicted in SEQ ID NO: 126 and a VL region as depicted in SEQ ID NO: 127;
(j) a VH region as depicted in SEQ ID NO: 138 and a VL region as depicted in SEQ ID NO: 139;
(k) a VH region as depicted in SEQ ID NO: 144 and a VL region as depicted in SEQ ID NO: 145;
(l) a VH region as depicted in SEQ ID NO: 156 and a VL region as depicted in SEQ ID NO: 157;
(m) a VH region as depicted in SEQ ID NO: 162 and a VL region as depicted in SEQ ID NO: 163;
(n) a VH region as depicted in SEQ ID NO: 180 and a VL region as depicted in SEQ ID NO: 181;
(o) a VH region as depicted in SEQ ID NO: 192 and a VL region as depicted in SEQ ID NO: 193;
(p) a VH region as depicted in SEQ ID NO: 198 and a VL region as depicted in SEQ ID NO: 199;
(q) a VH region as depicted in SEQ ID NO: 210 and a VL region as depicted in SEQ ID NO: 211;
(r) a VH region as depicted in SEQ ID NO: 216 and a VL region as depicted in SEQ ID NO: 217;
(s) a VH region as depicted in SEQ ID NO: 228 and a VL region as depicted in SEQ ID NO: 229;
(t) a VH region as depicted in SEQ ID NO: 234 and a VL region as depicted in SEQ ID NO: 235;
(u) a VH region as depicted in SEQ ID NO: 246 and a VL region as depicted in SEQ ID NO: 247;
(v) a VH region as depicted in SEQ ID NO: 252 and a VL region as depicted in SEQ ID NO: 253;
(w) a VH region as depicted in SEQ ID NO: 264 and a VL region as depicted in SEQ ID NO: 265;
(x) a VH region as depicted in SEQ ID NO: 270 and a VL region as depicted in SEQ ID NO: 271;
(y) a VH region as depicted in SEQ ID NO: 282 and a VL region as depicted in SEQ ID NO: 283;
(z) a VH region as depicted in SEQ ID NO: 288 and a VL region as depicted in SEQ ID NO: 289;
(aa) a VH region as depicted in SEQ ID NO: 300 and a VL region as depicted in SEQ ID NO: 301;
(ab) a VH region as depicted in SEQ ID NO: 306 and a VL region as depicted in SEQ ID NO: 307
(ac) a VH region as depicted in SEQ ID NO: 54 and a VL region as depicted in SEQ ID NO: 55
(ad) a VH region as depicted in SEQ ID NO: 174 and a VL region as depicted in SEQ ID NO: 175.
(ae) a VH region as depicted in SEQ ID NO: 318 and a VL region as depicted in SEQ ID NO: 319;
(af) a VH region as depicted in SEQ ID NO: 333 and a VL region as depicted in SEQ ID NO: 334;
(ag) a VH region as depicted in SEQ ID NO: 348 and a VL region as depicted in SEQ ID NO: 349;
(ah) a VH region as depicted in SEQ ID NO: 363 and a VL region as depicted in SEQ ID NO: 364;
(ai) a VH region as depicted in SEQ ID NO: 378 and a VL region as depicted in SEQ ID NO: 379;

(aj) a VH region as depicted in SEQ ID NO: 393 and a VL region as depicted in SEQ ID NO: 394;
(ak) a VH region as depicted in SEQ ID NO: 408 and a VL region as depicted in SEQ ID NO: 409;
(al) a VH region as depicted in SEQ ID NO: 423 and a VL region as depicted in SEQ ID NO: 424;
(am) a VH region as depicted in SEQ ID NO: 438 and a VL region as depicted in SEQ ID NO: 439;
(an) a VH region as depicted in SEQ ID NO: 453 and a VL region as depicted in SEQ ID NO: 454; and
(ao) a VH region as depicted in SEQ ID NO: 468 and a VL region as depicted in SEQ ID NO: 469.

It is furthermore envisaged that the first binding domain of the antibody construct of the invention comprises an amino acid sequence selected from the group consisting of those depicted in SEQ ID NOs: 50, 56, 68, 74, 86, 92, 104, 110, 122, 128, 140, 146, 158, 164, 176, 182, 194, 200, 212, 218, 230, 236, 248, 254, 266, 272, 284, 290, 302, 308, 320, 335, 350, 365, 380, 395, 410, 425, 440, 455, and 470.

The invention further provides an antibody construct comprising or having an amino acid sequence selected from the group consisting of SEQ ID NO: 51, 57, 69, 75, 87, 93, 105, 111, 123, 129, 141, 147, 159, 165, 177, 183, 195, 201, 213, 219, 231, 237, 249, 255, 267, 273, 285, 291, 303, 309, 321, 324, 336, 339, 351, 354, 366, 369, 381, 384, 396, 399, 411, 414, 426, 429, 441, 444, 456, 459, 471 and 474.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}$I or $^{131}$I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for cross-linking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. No. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^3$H, $^{14}$C, $^{15}$N, $^{35}$S, $^{89}$Zr, $^{90}$Y, $^{99}$Tc, $^{111}$In, $^{125}$I, $^{131}$I)
b) magnetic labels (e.g., magnetic particles)
c) redox active moieties
d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
e) enzymatic groups (e.g. horseradish peroxidase, β-galactosidase, luciferase, alkaline phosphatase)
f) biotinylated groups
g) predetermined polypeptide epitopes recognized by a secondary reporter (e.g., leucine zipper pair sequences, binding sides for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland.

Suitable proteinaceous fluorescent labels also include, but are not limited to, green fluorescent protein, including a Renilla, Ptilosarcus, or Aequorea species of GFP (Chalfie et al., 1994, Science 263:802-805), EGFP (Clontech Laboratories, Inc., GenBank® database Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, Biotechniques 24:462-471; Heim et al., 1996, Curr. Biol. 6:178-182), enhanced yellow fluorescent protein (EYFP, Clontech Laboratories, Inc.), luciferase (Ichiki et al., 1993, J. Immunol. 150:5408-5417), β galactosidase (Nolan et al., 1988, Proc. Natl. Acad. Sci. U.S.A. 85:2603-2607) and Renilla (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs may comprise a His-tag domain, which is generally known as a repeat of consecutive His residues in the amino acid sequence of a molecule, preferably of five, and more preferably of six His residues (hexa-histidine). The His-tag may be located e.g. at the N- or C-terminus of the antibody construct, preferably it is located at the C-terminus. Most preferably, a hexa-histidine tag (HHHHHH) (SEQ ID NO:16) is linked via peptide bond to the C-terminus of the antibody construct according to the invention. Additionally, a conjugate system of PLGA-PEG-PLGA may be combined with a poly-histidine tag for sustained release application and improved pharmacokinetic profile.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acid sequence modifications should result in an antibody construct which still retains the desired biological activity (binding to PSMA and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gin, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted, substituted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted, substituted or deleted in each of the FRs. Preferably, amino acid sequence insertions into the antibody construct include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. Corresponding modifications may also performed within the third domain of the antibody construct of the invention. An insertional variant of the antibody construct of the invention includes the fusion to the N-terminus or to the C-terminus of the antibody construct of an enzyme or the fusion to a polypeptide.

The sites of greatest interest for substitutional mutagenesis include (but are not limited to) the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions are then refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as PSMA or CD3 binding.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 3, below) is envisaged as long as the antibody construct retains its capability to bind to PSMA via the first domain and to CD3 epsilon via the second domain and/or its CDRs have an identity to the then substituted sequence (at least 60% or 65%, more preferably 70% or 75%, even more preferably 80% or 85%, and particularly preferably 90% or 95% identical to the "original" CDR sequence).

Conservative substitutions are shown in Table 3 under the heading of "preferred substitutions". If such substitutions result in a change in biological activity, then more substantial changes, denominated "exemplary substitutions" in Table 3, or as further described below in reference to amino acid classes, may be introduced and the products screened for a desired characteristic.

TABLE 3

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; asn, gin (3) acidic: asp, glu; (4) basic: his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, *Adv. Appl. Math.* 2:482, the sequence identity alignment algorithm of Needleman and Wunsch, 1970, *J. Mol. Biol.* 48:443, the search for similarity method of Pearson and Lipman, 1988, *Proc. Nat. Acad. Sci. U.S.A.* 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, *Nucl. Acid Res.* 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J. Mol. Evol.* 35:351-360; the method is similar to that described by Higgins and Sharp, 1989, *CABIOS* 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, *Nucl. Acids Res.* 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs or VH/VL sequences are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs or VH/VL sequences and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" or a "variant VH/VL region" is one with the specified homology, similarity, or identity to the parent CDR/VH/VL of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR or VH/VL.

In one embodiment, the percentage of identity to human germline of the antibody constructs according to the invention is ≥70% or ≥75%, more preferably ≥80% or ≥85%, even more preferably ≥90%, and most preferably ≥91%, ≥92%, ≥93%, ≥94%, ≥95% or even ≥96%. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In a further embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and hence the monomer percentage (i.e., monomer:(monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In one embodiment, the antibody constructs have a preferred plasma stability (ratio of EC50 with plasma to EC50 w/o plasma) of ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by EC50 determination in a $^{51}$chromium release cytotoxicity assay. The effector cells in the cytotoxicity assay can be stimulated enriched human CD8 positive T cells. Target cells can e.g. be CHO cells transfected with human PSMA. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control).

It is furthermore preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 μg/ml or 250 μg/ml in an incubator. Under these conditions, it is preferred that the antibody constructs of the invention show a dimer percentage that is 55%, more preferably 54%, even more preferably ≤3%, even more preferably ≤2.5%, even more preferably ≤2%, even more preferably ≤1.5%, and most preferably ≤1% or 50.5% or even 0%.

It is also preferred that the bispecific antibody constructs of the present invention present with very low dimer conversion after a number of freeze/thaw cycles. For example, the antibody construct monomer is adjusted to a concentration of 250 μg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are 55%, more preferably 54%, even more preferably ≤3%, even more preferably ≤2.5%, even more preferably ≤2%, even more preferably ≤1.5%, and most preferably ≤1% or even 50.5%, for example after three freeze/thaw cycles.

The bispecific antibody constructs of the present invention preferably show a favorable thermostability with aggregation temperatures ≥45° C. or ≥50° C., more preferably ≥52° C. or ≥54° C., even more preferably ≥56° C. or ≥57° C., and most preferably ≥58° C. or ≥59° C. The thermostability parameter can be determined in terms of antibody aggregation temperature as follows: Antibody solution at a concentration 250 μg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody.

Alternatively, temperature melting curves can be determined by Differential Scanning Calorimetry (DSC) to determine intrinsic biophysical protein stabilities of the antibody constructs. These experiments are performed using a MicroCal LLC (Northampton, Mass., U.S.A) VP-DSC device. The energy uptake of a sample containing an antibody construct is recorded from 20° C. to 90° C. compared to a sample containing only the formulation buffer. The antibody constructs are adjusted to a final concentration of 250 μg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

The PSMA×CD3 bispecific antibody constructs of the invention are also envisaged to have a turbidity (as measured by OD340 after concentration of purified monomeric antibody construct to 2.5 mg/ml and over night incubation) of ≤0.2, preferably of ≤0.15, more preferably of ≤0.12, even more preferably of ≤0.1, and most preferably of ≤0.08.

In a further embodiment the antibody construct according to the invention is stable at physiologic or slightly lower pH, i.e., about pH 7.4 to 6.0. The more tolerant the antibody construct behaves at unphysiologic pH such as about pH 6.0, the higher is the recovery of the antibody construct eluted from an ion exchange column relative to the total amount of loaded protein. Recovery of the antibody construct from an ion (e.g., cation) exchange column at about pH 6.0 is preferably ≥30%, more preferably ≥40%, more preferably ≥50%, even more preferably ≥60%, even more preferably ≥70%, even more preferably ≥80%, even more preferably ≥90%, even more preferably ≥95%, and most preferably ≥99%.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

On day 1 of the study, 5×10$^6$ cells of a human target cell antigen (here: PSMA) positive cancer cell line are subcutaneously injected in the right dorsal flank of female NOD/SCID mice. When the mean tumor volume reaches about 100 mm$^3$, in vitro expanded human CD3 positive T cells are transplanted into the mice by injection of about 2×10$^7$ cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm$^3$. The mean tumor size of each treatment group on the day of treatment start should not be statistically different from any other group (analysis of variance). Mice are treated with 0.5 mg/kg/day of a PSMA×CD3 bispecifc antibody construct by intravenous bolus injection for about 15 to 20 days. Tumors are measured by caliper during the study and progress evaluated by intergroup comparison of tumor volumes (TV). The tumor growth inhibition T/C [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

In a preferred embodiment of the antibody construct of the invention the antibody construct is a single chain antibody construct.

Also in a preferred embodiment of the antibody construct of the invention said third domain comprises in an amino to carboxyl order:

hinge-CH2-CH3-linker-hinge-CH2-CH3.

In one embodiment of the invention each of said polypeptide monomers of the third domain has an amino acid sequence that is at least 90% identical to a sequence selected from the group consisting of: SEQ ID NO: 17-24. In a preferred embodiment or the invention each of said polypeptide monomers has an amino acid sequence selected from SEQ ID NO: 17-24.

Also in one embodiment of the invention the CH2 domain of one or preferably each (both) polypeptide monomers of the third domain comprises an intra domain cysteine disulfide bridge. As known in the art the term "cysteine disulfide bridge" refers to a functional group with the general structure R—S—S—R. The linkage is also called an SS-bond or a disulfide bridge and is derived by the coupling of two thiol groups of cysteine residues. It is particularly preferred for the antibody construct of the invention that the cysteines forming the cysteine disulfide bridge in the mature antibody construct are introduced into the amino acid sequence of the CH2 domain corresponding to 309 and 321 (Kabat numbering).

In one embodiment of the invention a glycosylation site in Kabat position 314 of the CH2 domain is removed. It is preferred that this removal of the glycosylation site is achieved by a N314X substitution, wherein X is any amino acid excluding Q. Said substitution is preferably a N314G substitution N314G substitution. In a more preferred embodiment, said CH2 domain additionally comprises the following substitutions (position according to Kabat) V321C and R309C (these substitutions introduce the intra domain cysteine disulfide bridge at Kabat positions 309 and 321).

It is assumed that the preferred features of the antibody construct of the invention compared e.g. to the bispecific heteroFc antibody construct known in the art (FIG. 1B) may be inter alia related to the introduction of the above described modifications in the CH2 domain. Thus, it is preferred for the construct of the invention that the CH2 domains in the third domain of the antibody construct of the invention comprise the intra domain cysteine disulfide bridge at Kabat positions 309 and 321 and/or the glycosylation site at Kabat position 314 is removed by a N314G N314X substitution as above, preferably by a N314G substitution.

In a further preferred embodiment of the invention the CH2 domains in the third domain of the antibody construct of the invention comprise the intra domain cysteine disulfide bridge at Kabat positions 309 and 321 and the glycosylation site at Kabat position 314 is removed by a N314G substitution. Most preferably, the polypeptide monomer of the third domain of the antibody construct of the invention has an amino acid sequence selected from the group consisting of SEQ ID NO: 17 and 18.

In one embodiment the invention provides an antibody construct, wherein:

(i) the first domain comprises two antibody variable domains and the second domain comprises two antibody variable domains;

(ii) the first domain comprises one antibody variable domain and the second domain comprises two antibody variable domains;

(iii) the first domain comprises two antibody variable domains and the second domain comprises one antibody variable domain; or (iv) the first domain comprises one antibody variable domain and the second domain comprises one antibody variable domain.

Accordingly, the first and the second domain may be binding domains comprising each two antibody variable domains such as a VH and a VL domain. Examples for such binding domains comprising two antibody variable domains where described herein above and comprise e.g. Fv fragments, scFv fragments or Fab fragments described herein above. Alternatively either one or both of those binding domains may comprise only a single variable domain. Examples for such single domain binding domains where described herein above and comprise e.g. nanobodies or single variable domain antibodies comprising merely one variable domain, which may be VHH, VH or VL, that specifically bind an antigen or epitope independently of other V regions or domains.

In a preferred embodiment of the antibody construct of the invention first and second domain are fused to the third domain via a peptide linker. Preferred peptide linker have been described herein above and are characterized by the amino acid sequence Gly-Gly-Gly-Gly-Ser, i.e. Gly$_4$Ser (SEQ ID NO: 1), or polymers thereof, i.e. (Gly$_4$Ser)x, where x is an integer of 1 or greater (e.g. 2 or 3). A particularly preferred linker for the fusion of the first and second domain to the third domain is depicted in SEQ ID NOs: 1.

In a preferred embodiment the antibody construct of the invention is characterized to comprise in an amino to carboxyl order:
(a) the first domain;
(b) a peptide linker having an amino acid sequence selected from the group consisting of SEQ ID NOs: 1-3;
(c) the second domain;
(d) a peptide linker having an amino acid sequence selected from the group consisting of SEQ ID NO: 1, 2, 3, 9, 10, 11 and 12;
(e) the first polypeptide monomer of the third domain;
(f) a peptide linker having an amino acid sequence selected from the group consisting of SEQ ID NOs: 5, 6, 7 and 8; and
(g) the second polypeptide monomer of the third domain.

The antibody construct of the present invention comprises a first domain which binds to PSMA, preferably to the extracellular domain (ECD) of PSMA. It is understood that the term "binding to the extracellular domain of PSMA", in the context of the present invention, implies that the binding domain binds to PSMA expressed on the surface of a target cell. The first domain according to the invention hence preferably binds to PSMA when it is expressed by naturally expressing cells or cell lines, and/or by cells or cell lines transformed or (stably/transiently) transfected with PSMA. In a preferred embodiment the first binding domain also binds to PSMA when PSMA is used as a "target" or "ligand" molecule in an in vitro binding assay such as BIACORE™ or Scatchard. The "target cell" can be any prokaryotic or eukaryotic cell expressing PSMA on its surface; preferably the target cell is a cell that is part of the human or animal body, such as a specific PSMA expressing cancer or tumor cell.

Preferably, the first binding domain binds to human PSMA/PSMA ECD. In a further preferred embodiment, it binds to macaque PSMA/PSMA ECD. According to the most preferred embodiment, it binds to both the human and the macaque PSMA/PSMA ECD. The "PSMA extracellular domain" or "PSMA ECD" refers to the PSMA region or sequence which is essentially free of transmembrane and cytoplasmic domains of PSMA. It will be understood by the skilled artisan that the transmembrane domain identified for the PSMA polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein.

Preferred binding domains which bind to PSMA are disclosed in WO 2010/037836, and WO 2011/121110. Any binding domain for PSMA described in these applications may be used in the context of the present invention.

In one aspect of the invention the antibody construct comprises in an amino to carboxyl order:
(a) the first domain having an amino acid sequence selected from the group consisting of SEQ ID NOs: 50, 56, 68, 74, 86, 92, 104, 110, 122, 128, 140, 146, 158, 164, 176, 182, 194, 200, 212, 218, 230, 236, 248, 254, 266, 272, 284, 290, 302, 308, 320, 335, 350, 365, 380, 395, 410, 425, 440, 455, 470;
(b) a peptide linker having an amino acid sequence selected from the group consisting of SEQ ID NOs: 1-3;
(c) the second domain having an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 488-507, respectively, herein) or as depicted in SEQ ID NO: 15;
(d) a peptide linker having an amino acid sequence selected from the group consisting of SEQ ID NOs: 1, 2, 3, 9, 10, 11 and 12;
(e) the first polypeptide monomer of the third domain having a polypeptide sequence selected from the group consisting of SEQ ID NOs: 17-24;
(f) a peptide linker having an amino acid sequence selected from the group consisting of SEQ ID NOs: 5, 6, 7 and 8; and
(g) the second polypeptide monomer of the third domain having a polypeptide sequence selected from the group consisting of SEQ ID NOs: 17-24.

In line with this preferred embodiment, the first and second domain which are fused via a peptide linker to a single chain polypeptide comprise a sequence selected from the group consisting of: SEQ ID NO: 51, 57, 69, 75, 87, 93, 105, 111, 123, 129, 141, 147, 159, 165, 177, 183, 195, 201, 213, 219, 231, 237, 249, 255, 267, 273, 285, 291, 303, 309, 321, 324, 336, 339, 351, 354, 366, 369, 381, 384, 396, 399, 411, 414, 426, 429, 441, 444, 456, 459, 471 and 474.

In one aspect the antibody construct of the invention is characterized by having an amino acid sequence selected from the group consisting of: SEQ ID NOs: 52, 53, 58, 59, 70, 71, 76, 77, 88, 89, 94, 95, 106, 107, 112, 113, 124, 125, 130, 131, 142, 143, 148, 149, 160, 161, 166, 167, 178, 179, 184, 185, 196, 197, 202, 203, 214, 215, 220, 221, 232, 233, 238, 239, 250, 251, 256, 257, 268, 269, 274, 275, 286, 287, 292, 293, 304 305, 310, 311, 322, 323, 325, 326, 337, 338, 340, 341, 352, 353, 355, 356, 367, 368, 370, 371, 382, 383, 385, 386, 397, 398, 400, 401, 412, 413, 415, 416, 427, 428, 430, 431, 442, 443, 445, 446, 457, 458, 460, 461, 472, 473, 475 and 476.

The invention further provides a polynucleotide/nucleic acid molecule encoding an antibody construct of the invention. A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention. A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding side. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding side is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which may occur as a time-limited response to environmental conditions such as starvation and cell density.

Moreover, the invention provides a host cell transformed or transfected with the polynucleotide/nucleic acid molecule or with the vector of the invention. As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as *Neurospora*, *Penicillium*, *Tolypocladium*, and *Aspergillus* hosts such as *A. nidulans* and *A. niger*.

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, petunia, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, 1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J.T. Baker, Phillipsburg, N.J.) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention. It is preferred for the pharmaceutical composition of the invention that the homogeneity of the antibody construct is ≥80%, more preferably ≥81%, ≥82%, ≥83%, ≥84%, or ≥85%, further preferably ≥86%, ≥87%, ≥88%, ≥89%, or ≥90%, still further preferably, ≥91%, ≥92%, ≥93%, ≥94%, or ≥95% and most preferably ≥96%, ≥97%, ≥98% or ≥99%.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

amino acids such as glycine, alanine, glutamine, asparagine, threonine, proline, 2-phenylalanine, including charged amino acids, preferably lysine, lysine acetate, arginine, glutamate and/or histidine antimicrobials such as antibacterial and antifungal agents antioxidants such as ascorbic acid, methionine, sodium sulfite or sodium hydrogen-sulfite;

buffers, buffer systems and buffering agents which are used to maintain the composition at physiological pH or at a slightly lower pH; examples of buffers are borate, bicarbonate, Tris-HCl, citrates, phosphates or other organic acids, succinate, phosphate, and histidine; for example Tris buffer of about pH 7.0-8.5;

non-aqueous solvents such as propylene glycol, polyethylene glycol, vegetable oils such as olive oil, and injectable organic esters such as ethyl oleate;

aqueous carriers including water, alcoholic/aqueous solutions, emulsions or suspensions, including saline and buffered media;

biodegradable polymers such as polyesters;

bulking agents such as mannitol or glycine;

chelating agents such as ethylenediamine tetraacetic acid (EDTA);

isotonic and absorption delaying agents;

complexing agents such as caffeine, polyvinylpyrrolidone, beta-cyclodextrin or hydroxypropyl-beta-cyclodextrin)

fillers;

monosaccharides; disaccharides; and other carbohydrates (such as glucose, mannose or dextrins); carbohydrates may be non-reducing sugars, preferably trehalose, sucrose, octasulfate, sorbitol or xylitol;

(low molecular weight) proteins, polypeptides or proteinaceous carriers such as human or bovine serum albumin, gelatin or immunoglobulins, preferably of human origin;

coloring and flavouring agents;

sulfur containing reducing agents, such as glutathione, thioctic acid, sodium thioglycolate, thioglycerol, [alpha]-monothioglycerol, and sodium thio sulfate diluting agents;

emulsifying agents;

hydrophilic polymers such as polyvinylpyrrolidone)

salt-forming counter-ions such as sodium;

preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);

metal complexes such as Zn-protein complexes;

solvents and co-solvents (such as glycerin, propylene glycol or polyethylene glycol);

sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;

suspending agents;

surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;

stability enhancing agents such as sucrose or sorbitol;

tonicity enhancing agents such as alkali metal halides, preferably sodium or potassium chloride, mannitol sorbitol;

parenteral delivery vehicles including sodium chloride solution, Ringer's dextrose, dextrose and sodium chloride, lactated Ringer's, or fixed oils;

intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention may comprise, in addition to the polypeptide of the invention defined herein, further biologically active agents, depending on the intended use of the composition. Such agents may be drugs acting on the gastrointestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denature and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As may be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above. It is an envisaged characteristic of the antibody constructs of the present invention provided with the specific FC modality that they comprise, for example, differences in pharmacokinetic behavior. A half-life extended targeting antibody construct according to the present invention preferably shows a surprisingly increased residence time in vivo in comparison to "canonical" non-HLE versions of said antibody construct.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

In a preferred aspect of the invention the pharmaceutical composition is stable for at least four weeks at about −20° C. As apparent from the appended examples the quality of an antibody construct of the invention vs. the quality of corresponding state of the art antibody constructs may be tested using different systems. Those tests are understood to be in line with the "ICH Harmonised Tripartite Guideline: Stability Testing of Biotechnological/Biological Products Q5C and Specifications: Test procedures and Acceptance Criteria for Biotech Biotechnological/Biological Products Q6B" and, thus are elected to provide a stability-indicating profile that provides certainty that changes in the identity, purity and potency of the product are detected. It is well accepted that the term purity is a relative term. Due to the effect of glycosylation, deamidation, or other heterogeneities, the absolute purity of a biotechnological/biological product should be typically assessed by more than one method and the purity value derived is method-dependent. For the purpose of stability testing, tests for purity should focus on methods for determination of degradation products.

For the assessment of the quality of a pharmaceutical composition comprising an antibody construct of the invention may be analyzed e.g. by analyzing the content of soluble aggregates in a solution (HMWS per size exclusion). It is preferred that stability for at least four weeks at about −20° C. is characterized by a content of less than 1.5% HMWS, preferably by less than 1% HMWS.

A preferred formulation for the antibody construct as a pharmaceutical composition may e.g. comprise the components of a formulation as described below:

Formulation:
  potassium phosphate, L-arginine hydrochloride, trehalose dihydrate, polysorbate 80 at pH 6.0

Other examples for the assessment of the stability of an antibody construct of the invention in form of a pharmaceutical composition are provided in the appended examples 4-12. In those examples embodiments of antibody constructs of the invention are tested with respect to different stress conditions in different pharmaceutical formulations and the results compared with other half-life extending (HLE) formats of bispecific T cell engaging antibody construct known from the art. In general, it is envisaged that antibody constructs provided with the specific FC modality according to the present invention are typically more stable over a broad range of stress conditions such as temperature and light stress, both compared to antibody constructs provided with different HLE formats and without any HLE format (e.g. "canonical" antibody constructs). Said temperature stability may relate both to decreased (below room temperature including freezing) and increased (above room temperature including temperatures up to or above body temperature) temperature. As the person skilled in the art will acknowledge, such improved stability with regard to stress, which is hardly avoidable in clinical practice, makes the antibody construct safer because less degradation products will occur in clinical practice. In consequence, said increased stability means increased safety.

One embodiment provides the antibody construct of the invention or the antibody construct produced according to the process of the invention for use in the prevention, treatment or amelioration of a cancer correlating with PSMA expression or PSMA overexpression, such as prostate cancer.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a disease as specified herein below, by the administration of an antibody construct according to the invention to a subject in need thereof. Such an improvement may also be seen as a slowing or stopping of the progression of the patient's disease. The term "prevention" as used herein means the avoidance of the occurrence or re-occurrence of a patient having a tumor or cancer or a metastatic cancer as specified herein below, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metatstatic cancer" encompasses metastases to other tissues or organs than the one of the original tumor. Lymphomas and leukemias are lymphoid neoplasms. For the purposes of the present invention, they are also encompassed by the terms "tumor" or "cancer".

The term "viral disease" describes diseases, which are the result of a viral infection of a subject.

The term "immunological disorder" as used herein describes in line with the common definition of this term immunological disorders such as autoimmune diseases, hypersensitivities, immune deficiencies.

In one embodiment the invention provides a method for the treatment or amelioration of a cancer correlating with PSMA expression or PSMA overexpression, comprising the step of administering to a subject in need thereof the antibody construct of the invention, or the antibody construct produced according to the process of the invention. The PSMA×CD3 bispecific single chain antibody is particularly advantageous for the therapy of cancer, preferably solid tumors, more preferably carcinomas and prostate cancer.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, opthalmic, auricular/aural, vaginal, mucosal);
enteral routes (such as oral, gastrointestinal, sublingual, sublabial, buccal, rectal); and parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating diseases correlating with PSMA expression as described herein above, a therapeutically effective amount of the antibody construct of the invention, here: an anti-PSMA/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events may refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Finally, the invention provides a kit comprising an antibody construct of the invention or produced according to the process of the invention, a pharmaceutical composition of the invention, a polynucleotide of the invention, a vector of the invention and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

It must be noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within 20%, preferably within 10%, and more preferably within 5% of a given value or range. It includes, however, also the concrete number, e.g., about 20 includes 20.

The term "less than" or "greater than" includes the concrete number. For example, less than 20 means less than or equal to. Similarly, more than or greater than means more than or equal to, or greater than or equal to, respectively.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

It should be understood that this invention is not limited to the particular methodology, protocols, material, reagents, and substances, etc., described herein and as such can vary. The terminology used herein is for the purpose of describing particular embodiments only, and is not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

A better understanding of the present invention and of its advantages will be obtained from the following examples, offered for illustrative purposes only. The examples are not intended to limit the scope of the present invention in any way.

Example 1: BiTE® Induced CD69 Expression on T Cells in Absence of Target Cells

Isolated PBMC from healthy human donors were cultured with increasing Target B/CD3 or Target A/CD3 HLE bispecific antibody constructs for 48 h. The expression of the activation marker CD69 on T cells was determined by immunostaining and flow cytometry and antigen specific conjugates mAb.

Target-independent T cell activation in terms of CD69 upregulation was observed for all anti-CDH 19 constructs but was most pronounced for heteroFc and crossbody molecules. Upregulation of CD69 by anti-Target B-scFc occurred at higher concentrations and the amplitude was in part lower compared to the other two Fc-based constructs.

For the anti-Target A almost no target-independent T cell activation was observed for the scFc-containing molecule, while the heteroFc construct induced a strong upregulation of CD69 on the cell surface T cells in the absence of target cells.

Target-independent T cell activation induced by BiTE® antibody constructs containing a single chain-Fc, or hetero-Fc fusion at the C-terminus was evaluated for the following constructs:

BiTE® antibody constructs (serial dilutions: 0.1 pM-2 µM)
 a. Target A-I2C scFc; 1.14 mg/mL;
 b. Target A Hetero Fc; 1.02 mg/mL
Human PBMC effector cells (3 donors; #065, #823, #836 (scFc) #401, #415, #433 (heteroFc); #590, #595, 598, #605 (X-body)).
48 h incubation time.

Figure 2A:
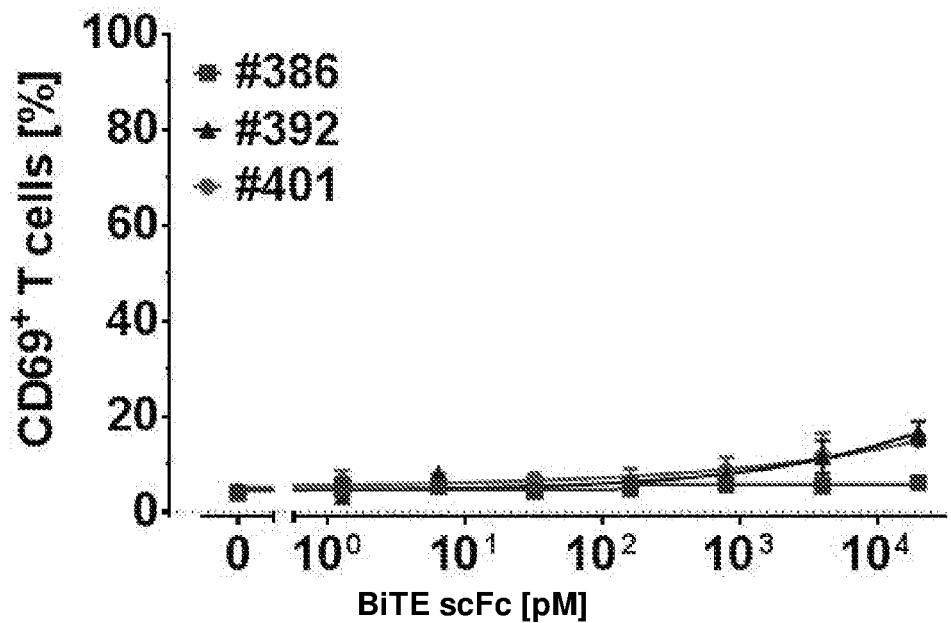
FIGS. 2A-2B: Evaluation of Target-independent T Cell Activation by Target A HLE BiTE® antibody constructs.
Figure 2B:
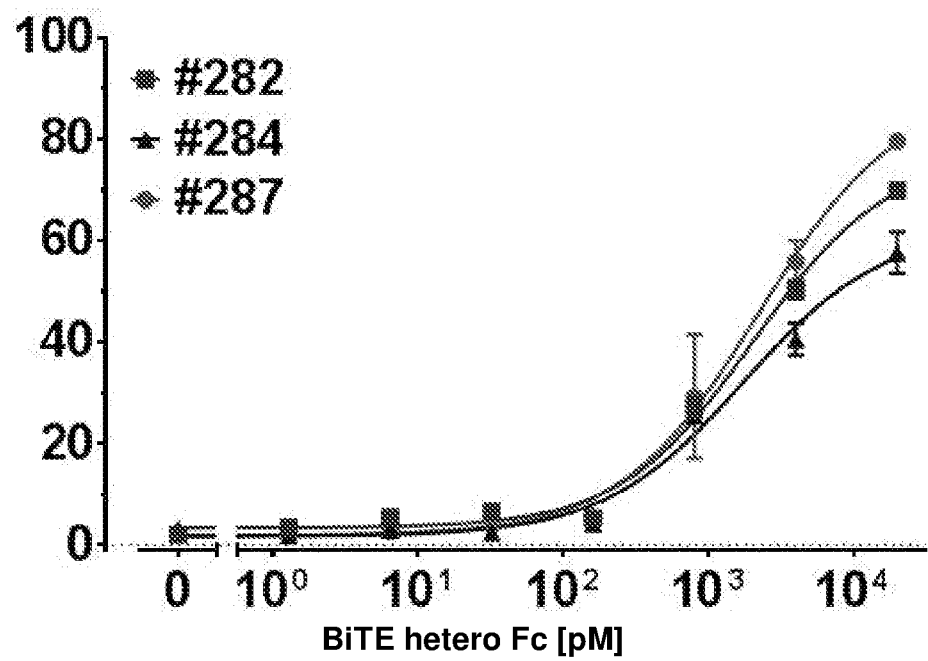
Figure 3A:
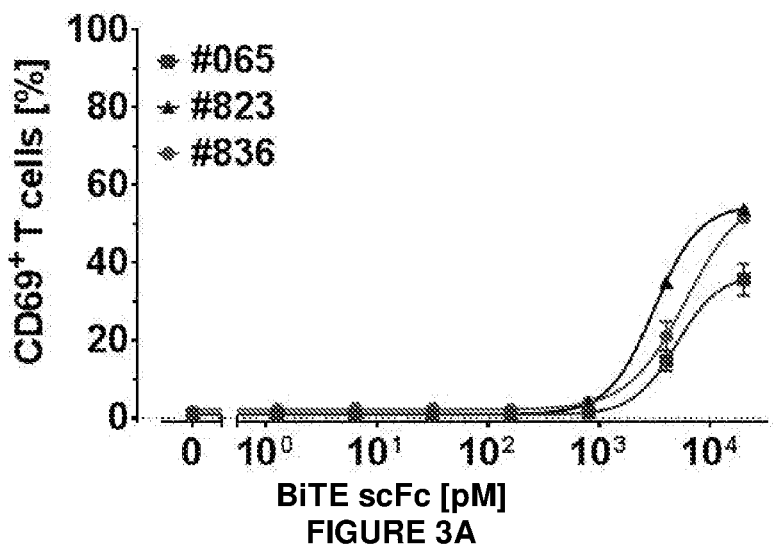
FIGS. 3A-3F: Evaluation of Target-independent T Cell Activation by Target B HLE BiTE® antibody constructs.
Figure 3B:
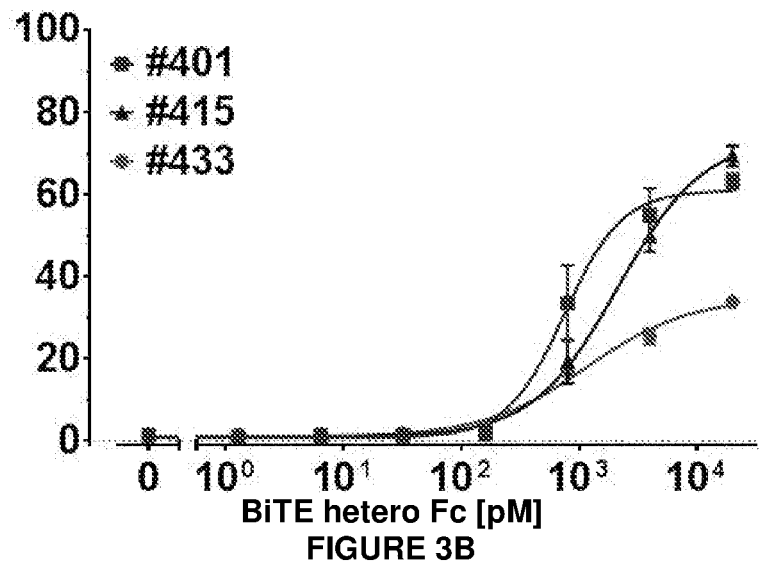
Figure 3C:
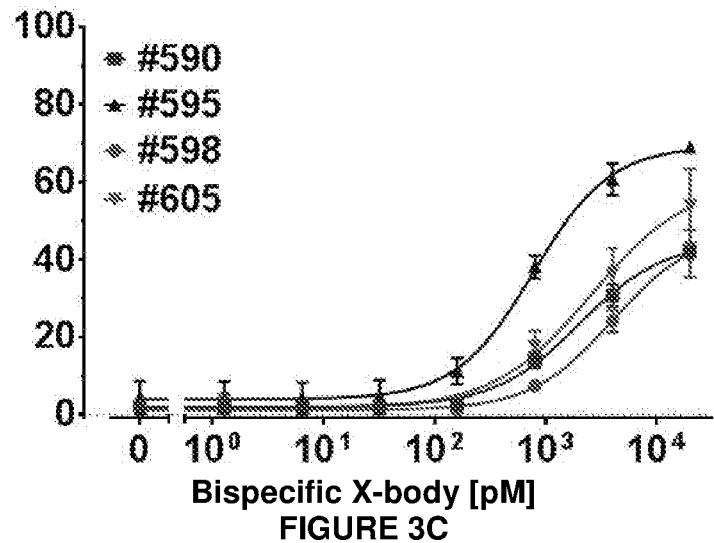
Figure 3D:
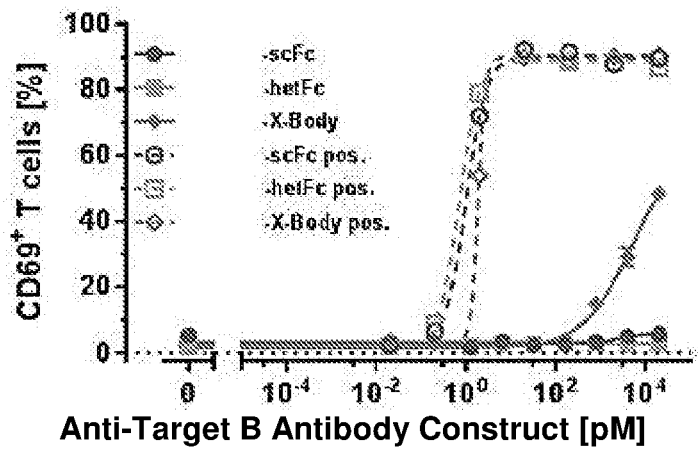
Figure 3E:
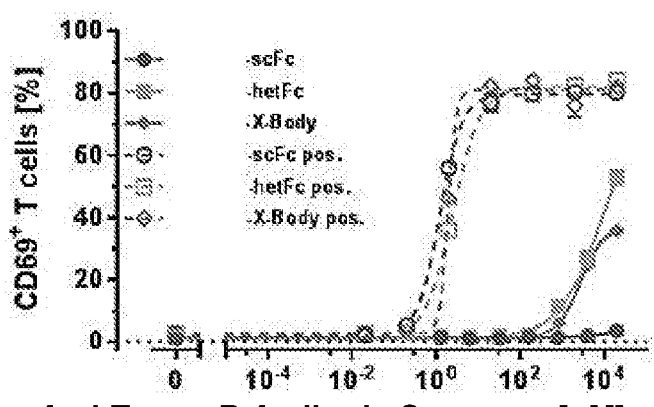
Figure 3F:
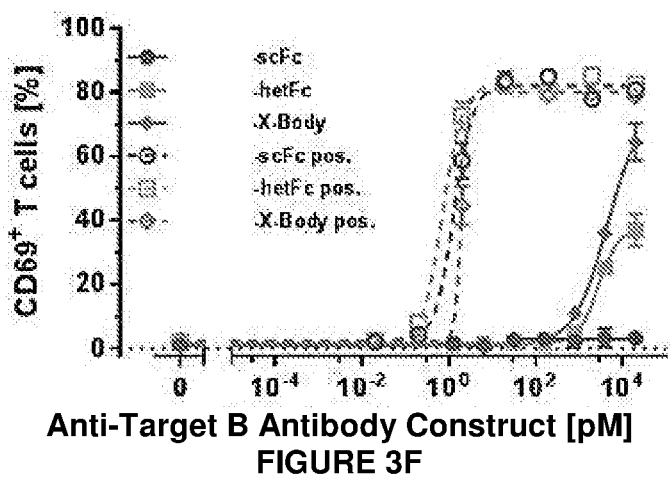

Determination of CD69 expression on CD4+ and CD8+ T cells with flow cytometer and antigen-specific conjugates mAb. Results see FIGS. 2A-2B.

Target-independent T cell activation induced by BiTE® antibody constructs containing a single chain-Fc, hetero-Fc or crossbody fusion at the C-terminus was evaluated for the following constructs:

BiTE® antibody constructs (serial dilutions: 0.1 pM-2 µM)
 c. Target B×I2C-scFc; 245.3 µg/mL
 d. Target B Hetero Fc; 1 mg/mL
 e. Target B crossbody; 6.3 mg/mL
Human PBMC effector cells (3 to 4 donors; #386, #392, #401 (scFc) #282, #284, #287 (heteroFc)). 48 h incubation time.

Determination of CD69 expression on CD4+ and CD8+ T cells with flow cytometer and antigen-specific conjugates mAb. Results see FIGS. 3A-3F.

Target-independent T cell activation in terms of CD69 upregulation was observed for several bispecific antibody constructs tested in these assays. The CD69 upregulation was in general more pronounced for the canonical BiTE® antibody constructs, heteroFc and crossbody antibody constructs when compared to the respective scFc antibody constructs. Upregulation of CD69 by the scFc constructs occurred in general at slightly higher concentrations and the amplitude was in part lower compared to the other two Fc-based constructs.

For the anti-Target B scFc antibody construct, no target-independent T cell activation was observed, while the heteroFc and X-Body antibody constructs induced a strong upregulation of CD69 on the cell surface of T cells in the absence of target cells. Hence, the scFc antibody construct according to the present invention shows an advantage as unspecific T cell activation, as exemplified here by CD69 upregulation, is not desired in specific immunotherapy.

Materials and Methods
Target B
Target-independent T cell activation induced by a BiTE® antibody constructs containing a single chain-Fc for the following construct:
1. BiTE® antibody construct (serial dilutions: 1.3 pM-20 nM)
   1. Target B-scFc
   2. Human PBMC effector cells (3 donors)
   3. 48 h incubation time
   4. Flow cytometric analysis of CD69 expression on CD4+ and CD8+ T cells using a PE-Cy7 conjugated mAb specific for CD69.

Example 2

Purified BiTE® antibody constructs were coated on a Maxisorb Plate in decreasing concentration (100 nM, 1:4 dilutions). After 3× washing with PBS-T and blocking with PBS/3% (w/v) BSA (60 min, 37° C.), pooled human plasma was incubated for 60 min, 80 rpm at room temperature. After 3× washing a mouse monoclonal antibody specific for human C1q subunit A (CC1q) was added (Thermo MA1-83963, 1:500) for 60 min, 80 rpm, room temperature, after described washing steps a goat anti mouse Fc-POX mAb (1:5,000) was incubated for 60 min, 80 rpm, room temperature. After additional washing, TMB substrate was incubated and stopped after colorimetric reaction by addition of $H_2SO_4$. The absorption was determined at 450 nm.

Figure 4:
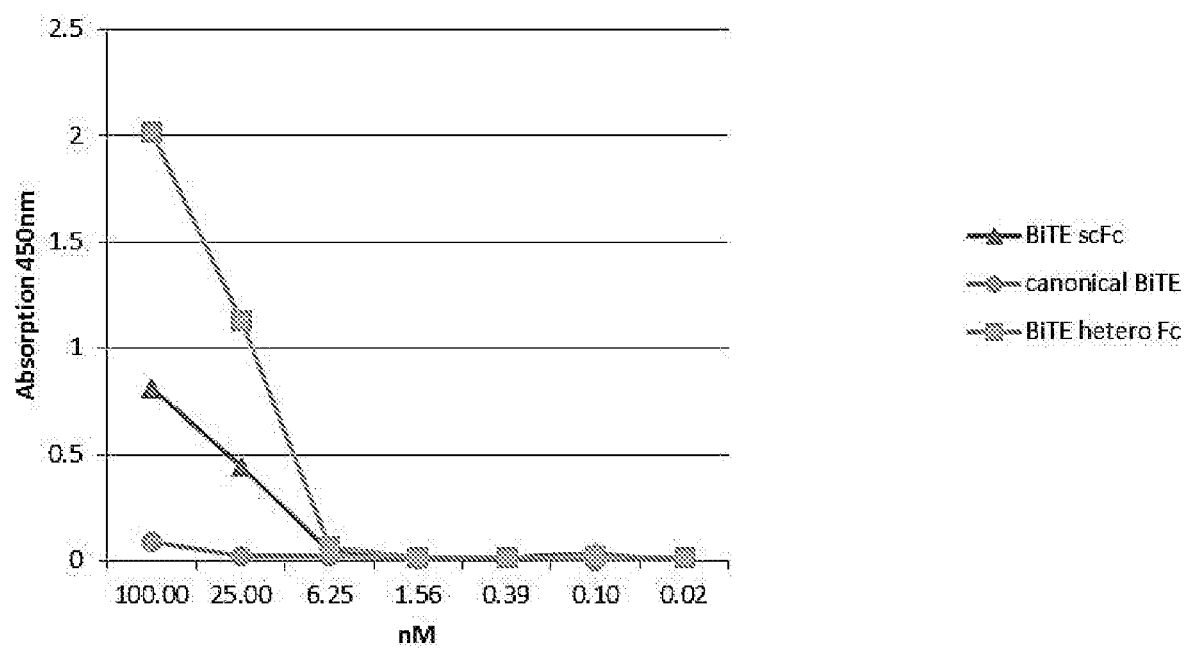

Result: As shown in FIG. 4 at high concentrations, the BiTE® hetero Fc antibody construct (squares) showed higher binding signals for human CC1q compared to a BiTE® single chain Fc antibody construct (triangle). As a negative control a canonical BiTE® antibody construct (circle) was used, which showed no significant CC1q binding.

Example 3: Pharmacokinetics of BITE® Antibody Constructs Fused to Half-Life Extension Modalities Two PSMA-targeting BiTE® antibody constructs were tested in the cynomolgus monkey in the context of pharmacokinetic (PK) studies. One BiTE® antibody construct was fused to a scFc half-life extending (HLE) moiety whereas the other one was used as single, non-half-life extended (non-HLO) "canonical" BiTE® antibody construct. The corresponding nomenclature of both molecules is briefly summarized in Table 4 below.

TABLE 4

Compound nomenclature of two single dosed BiTE ® antibody constructs

| compound synonyme | test compound name | target |
|---|---|---|
| Compound 11a | PM 76-B10-scFc | PSMA |
| Compound 11b | MTR112-5 | |

The BiTE®-HLE antibody construct (compound 11a) was administered as short intravenous bolus injection, the canonical antibody construct as a continuous intravenous infusion (compound 11b). To compare pharmacokinetic parameters for both antibody constructs, only the terminal phase starting directly after end of infusion is shown for the canonical PSMA-BiTE® antibody construct. The BiTE® antibody constructs were administered in a dose-linear, pharmacokinetic relevant range of 15 µg/kg (compound 11a) and 15.4 µg/kg/day (compound 11b), respectively. For reasons of comparability the serum concentrations shown are dose-normalized and molecular weight-normalized (indicated in nmol).

For each of the above named compounds a group of two animals was used. Blood samples were collected and serum was prepared for determination of serum concentrations. Serum BiTE® antibody construct levels were measured using an immunoassay. This sandwich ELISA assay is performed by capturing via a specific BiTE® targeting antibody, while an antibody directed against the CD3-binding part of the construct was used for detection. The serum concentration-time profiles were used to determine PK parameters.

Blood sampling time points are listed for both study designs in Table 5 below.

TABLE 5

Blood sampling time points during PK studies.

| blood sampling time points: HLE antibody construct; [h] after start of infusion | blood sampling time points: canonical antibody construct; [h] after start of infusion |
|---|---|
| 0.085 | 167.76 |
| 0.25 | 168.96 |
| 0.5 | 172.08 |
| 1 | 175.92 |
| 4 | 180.00 |
| 8 | 192.00 |
| 24 | |
| 48 | |
| 72 | |
| 168 | |
| 240 | |
| 336 | |

Figure 5:
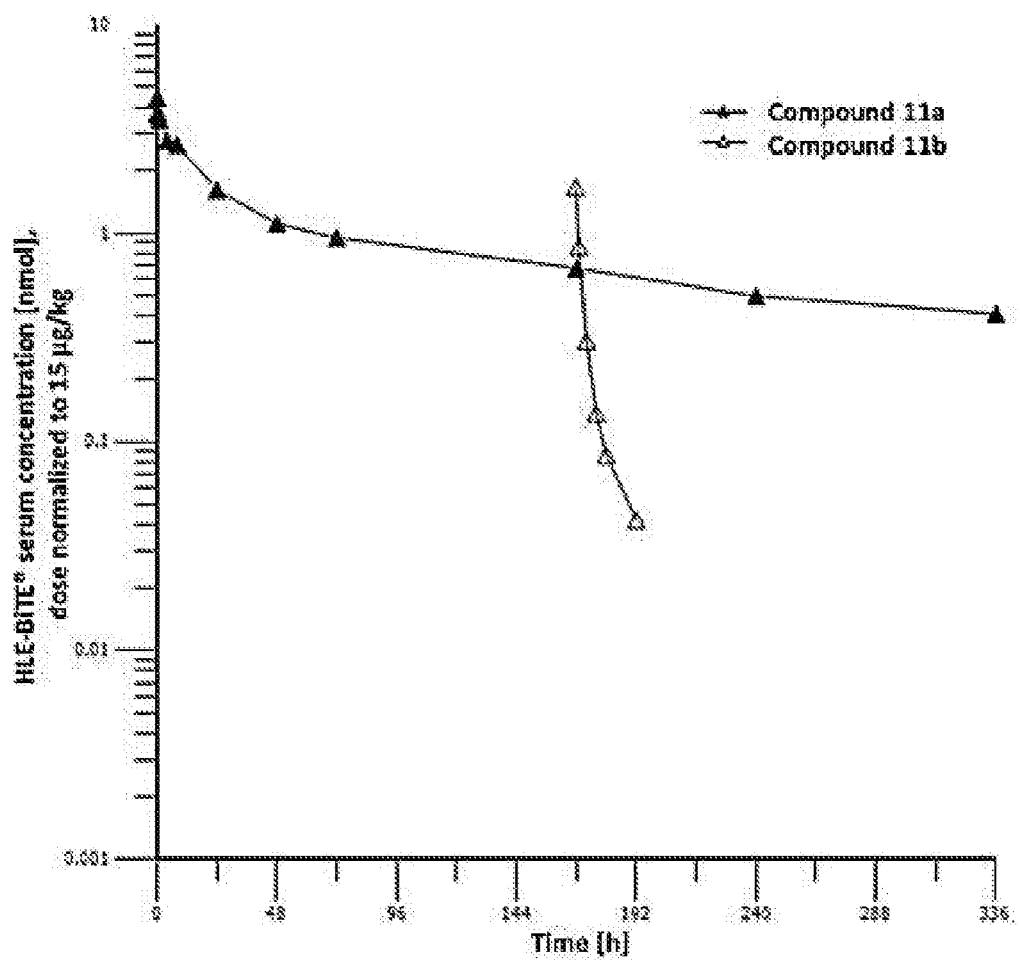
FIG. 5: Mean PK profiles of two different PSMA BiTE®-HLE antibody constructs after single dose administration in cynomolgus monkeys. For reasons of comparability, serum concentrations were dose-normalized to 15 μg/kg and indicated in nmol.

The pharmacokinetics of the two BiTE® antibody constructs are shown exemplarily. Each compound group stands for the same BiTE® antibody construct either fused to a scFc half-life extending moiety or left as canonical molecule. For all proteins serum levels were quantifiable for all time points in all animals after BiTE®-HLE antibody construct administration. (FIG. 5).

The pharmacokinetic parameters were determined using standard non-compartmental analysis (NCA) methods. Using non compartmental analysis, the following PK parameters were estimated: $AUC_{inf}$ (Area under the serum concentration-time curve), Vss (volume of distribution at steady state), CL (systemic clearance) and terminal $t_{1/2}$ (terminal half-life).

The PK parameter for each tested compound are summarized as mean of n=2 in Table 6 below.

TABLE 6

Pharmacokinetic parameter of two PSMA targeting BiTE ® antibody constructs tested in cynomolgus monkeys.

| test item | terminal $t_{1/2}$ [h] | $AUC_{inf}$ [normalized to 15 µg/kg] [h * ng/mL] | Cl [mL/h/kg] | Vss [mL/kg] |
|---|---|---|---|---|
| Compound 11a | 214 | 43014 | 0.4 | 98 |
| Compound 11b | 6 | 7763 | 13.5 | 1132 |

Typically the PK profile for the canonical PSMA-BiTE® antibody constructs describes a very steeply declining serum concentration profile related to the clearance mechanism of these canonical proteins. The half-life extended PSMA-targeting BiTE®-scFc antibody construct shows a biphasic, exponential decline after single test item administrations in cynomolgus monkeys.

Overall, the PSMA-BiTE® antibody construct (Compound 11a) fused to a scFc HLE-modality shows a mean $AUC_{inf}$ of 43014 h*ng/mL, a systemic clearance value of 0.4 mL/h/kg, as well as a corresponding volume of distribution of 98 mL/kg. Compound 11b, the canonical, i.e. non-half-life extended PSMA targeting BiTE® antibody construct shows a high clearance of 13.5 mL/h/kg leading to a low serum exposure of 7763 h*ng/mL.

The differences in pharmacokinetic behavior of the two different BiTE® antibody constructs tested exemplifies the general advantage of the half-life extended PSMA targeting BiTE®-scFc antibody construct over the corresponding canonical non-HLE version, especially in terms of residence time of the substance in the body.

Example 4

Preformulated drug substances containing purified Target A-hALB, Target A-hFc, and Target A-scFc antibody constructs respectively were buffer exchanged via ultrafiltration/diafiltration using membranes with a molecular weight cut-off (MWCO) of 10 kDa. Final formulation was achieved by adding concentrated stock solutions. Resulting formulations for each construct are listed in Table 7 The target protein concentration was 1.0 mg/mL. Formulated Target A antibody constructs were filled to 1 mL in type I glass vials which were stoppered with butyl rubber stoppers and crimped with aluminum seals. Filled vials were incubated at −20, 5, 25 and 37° C. One vial of each version was subjected to five freeze and thaw (F/T) cycles. Target freezing temperature was −29° C. Target thawing temperature was 2° C. The ramp rate was approximately 0.3 K/min.

Visual particles were assessed in accordance to the method described by Ph Eur 2.9.20 by trained operators. Visual particle counts per vial are depicted in Table 7. The number of visual (larger than 125 µm) proteinaceous particles was higher for Target A-hFc if compared to both Target A-hALB and Target A-scFc.

TABLE 7

Number of visual proteinaceous particles per vial for stressed and unstressed (T0) samples containing different half-life extended anti-Target A BiTE ® antibody constructs.

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| Number of visible (>125 µm) proteinaceous particles per vial | | | | | |
| T0 | 0 | 0 | 1 | 0 | 0 |
| 5 F/T cycles | 0 | 2 | 2 | 0 | 1 |
| 2 w 5° C. | 0 | 2 | 2 | 0 | 0 |
| 2 w 25° C. | 0 | 2 | 1 | 0 | 0 |
| 2 w 37° C. | 0 | 2 | 2 | 0 | 0 |
| 4 w −20° C. | 0 | 2 | 1 | 0 | 0 |
| 4 w 5° C. | 0 | 1 | 2 | 0 | 0 |
| 4 w 25° C. | 0 | 2 | 2 | 0 | 0 |
| 4 w 37° C. | 0 | 2 | 2 | 0 | 0 |

The samples described above were also analyzed by size exclusion ultra-high performance chromatography (SE-UPLC) in order to quantify the percentaged content of high molecular weight species (HMWS). SE-UPLC was performed on an AcquityH-Class UPLC system (Waters) using an Acquity UPLC BEH200 SEC 150 mm column (Waters). Column temperature was set to 25° C. Separation of size variants was achieved by applying an isocratic method with a flow rate of 0.4 mL/min. The mobile phase was composed of 100 mM sodium phosphate, 250 mM NaCl at pH 6.8. The run time totals 6.0 minutes. Samples were held at 8° C. within the autosampler until analysis. A total amount of 3 µg protein was injected. In order to avoid carry over an intermediate injection with 40% acetonitrile was performed after each sample. Detection was based on fluorescence emission (excitation at 280 nm, emission at 325 nm). Peak integration was performed using Empower® software. Relative area under the curve of HMWS was reported (Table 8).

Fc-based antibody constructs exhibited lower HMWS contents in the formulation variant G40MSuT than in K60RTrT independent on the stress condition. It became evident that Target A-scFc contained less HMWS than Target A-hFc in both G40MSuT as well as K60RTrT preparations. Target A-scFc in its preferred formulation (G40MSuT) was less prone to HMWS formation than Target A-hALB formulated in K60RTrT. In previous experiments this buffer showed improved stabilizing potential for hALB based constructs.

TABLE 8

Overview on HMWS contents in stressed and unstressed (T0) Target A-hALB, -hFc, and -scFc antibody construct preparations determined via SE-UPLC

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| % HMWS | | | | | |
| T0 | 1.8 | 6.7 | 3.3 | 2.5 | 1.3 |
| 5 F/T cycles | 2.0 | 7.2 | 4.1 | 3.0 | 1.5 |
| 2 w 5° C. | n.t. | n.t. | n.t. | 2.9 | 1.1 |
| 2 w 25° C. | n.t. | 6.6 | 2.7 | 2.4 | 0.5 |
| 2 w 37° C. | 2.6 | 6.3 | 2.1 | 2.7 | 0.3 |
| 4 w −20° C. | 5.9 | 8.7 | 1.6 | 6.6 | 0.3 |
| 4 w 5° C. | 2.0 | 8.2 | 2.8 | 3.6 | 0.6 |
| 4 w 25° C. | 2.2 | 6.8 | 2.6 | 2.7 | 0.4 |
| 4 w 37° C. | 3.5 | 7.6 | 1.9 | 4.3 | 0.3 | n.t. = not tested

The abundance of chemical modifications upon heat stress (incubation at 37° C.) was monitored by peptide mapping. Protein samples were enzymatically digested and the resulting peptides were separated using reversed phase chromatography. The column eluate was directly injected into the ion source of a mass spectrometer for identification and quantitation of the peptides.

In order to achieve maximum coverage, two separate enzyme digests were performed: once with trypsin and once with chymotrypsin. In each case, the proteins were denatured with guanidinum chloride and then reduced with dithiothreitol (DTT). After incubation in DTT, free cysteine residues were alkylated by the addition of iodoacetic acid. Samples were then buffer exchanged into 50 mM Tris pH 7.8 for digestion. Trypsin and chymotrypsin were added to separate reaction tubes at a ratio of 1:10 (sample:enzyme) each. Samples were digested for 30 min at 37° C. and the reaction was quenched by adding trifluoroacetic acid.

A load of 5 µg of each digest was separately injected onto a Zorbax SB-C18 (Agilent #859700-902) reversed phase column equilibrated in 0.1% (V/V) formic acid (FA). A 156 minutes gradient of up to 90% acetonitrile containing 0.1% FA was used to elute the peptides directly into the electrospray ion source of a Q-Exactive Plus mass spectrometer (Thermo Scientific). Data was collected in data dependent mode using a top 12 method in which a full scan (resolution 70 000; scan range 200-2000 m/z) was followed by high energy collision dissociation (HCD) of the 12 most abundant ions (resolution 17 500).

Peptides were identified based on accurate mass and tandem mass spectrum using in-house software. Identifications were manually verified. Relative quantities of modified and unmodified peptides were calculated based on ion abundance using Pinpoint software (Thermo Scientific).

Percentages of chemical modifications of the complement determining regions (CDRs) and of the half-life extending portion (either hALB or Fc) detected in Target A-hALB, -hFc, and -scFc antibody construct preparations are given by Table 9. When comparing similar formulation conditions, it became obvious that overall, chemical modifications were least abundant in scFc constructs.

TABLE 9

Overview on chemical modifications in stressed and unstressed (T0) Target A-hALB, -hFc, and -scFc antibody construct preparations determined via peptide mapping

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| % N101 deamidation (CDR) | | | | | |
| T0 | 0.1 | 0.2 | 0.2 | 0.2 | 0.2 |
| 2 w 37° C. | 0.7 | 0.8 | 3.0 | 0.7 | 3.2 |
| 4 w 37° C. | 1.3 | n.t. | 8.5 | n.t. | 6.4 |
| % N162 deamidation (CDR) | | | | | |
| T0 | 3.0 | 1.7 | 1.9 | 2.3 | 2.5 |
| 2 w 37° C. | 15.9 | 11.6 | 2.7 | 15.0 | 3.3 |
| 4 w 37° C. | 26.8 | n.t. | 3.7 | n.t. | 4.1 |
| % M279 oxidation (CDR) | | | | | |
| T0 | 0.6 | 1.4 | 1.6 | 0.6 | 1.0 |
| 2 w 37° C. | 1.2 | 0.8 | 0.8 | 0.6 | 1.0 |
| 4 w 37° C. | 0.9 | n.t. | 0.8 | n.t. | 0.6 |
| % N348 deamidation (CDR) | | | | | |
| T0 | 0.5 | 3.2 | 3.3 | 0.5 | 0.9 |
| 2 w 37° C. | 20.5 | 21.6 | 1.9 | 9.4 | 1.3 |
| 4 w 37° C. | 22.8 | n.t. | 2.0 | n.t. | 2.9 |
| % N351 deamidation (CDR) | | | | | |
| T0 | 0.2 | 2.9 | 2.6 | 0.5 | 1.0 |
| 2 w 37° C. | 6.6 | 12.7 | 0.9 | 3.8 | 0.4 |
| 4 w 37° C. | 8.7 | n.t. | 0.8 | n.t. | 0.8 |
| % M530 oxidation (Fc) | | | | | |
| T0 | n.a. | 3.9 | 4.1 | 2.6 | 3.2 |
| 2 w 37° C. | n.a. | 9.0 | 3.1 | 4.0 | 4.3 |
| 4 w 37° C. | n.a. | n.t. | 3.4 | n.t. | 3.5 |
| % N603 deamidation (Fc) | | | | | |
| T0 | n.a. | 1.3 | 1.9 | 1.3 | 1.4 |
| 2 w 37° C. | n.a. | 7.9 | 4.6 | 7.0 | 5.6 |
| 4 w 37° C. | n.a. | n.t. | 6.9 | n.t. | 8.1 |
| % M706 oxidation (Fc) | | | | | |
| T0 | n.a. | 3.2 | 3.6 | 1.5 | 2.1 |
| 2 w 37° C. | n.a. | 6.0 | 2.8 | 2.1 | 2.5 |
| 4 w 37° C. | n.a. | n.t. | 2.6 | n.t. | 2.0 |
| % M587 oxidation (hALB) | | | | | |
| T0 | 1.0 | n.a. | n.a. | n.a. | n.a. |
| 2 w 37° C. | 2.2 | n.a. | n.a. | n.a. | n.a. |
| 4 w 37° C. | 2.3 | n.a. | n.a. | n.a. | n.a. |
| % M623 oxidation (hALB) | | | | | |
| T0 | 1.9 | n.a. | n.a. | n.a. | n.a. |
| 2 w 37° C. | 2.4 | n.a. | n.a. | n.a. | n.a. |
| 4 w 37° C. | 3.0 | n.a. | n.a. | n.a. | n.a. |
| % M798 oxidation (hALB) | | | | | |
| T0 | 1.4 | n.a. | n.a. | n.a. | n.a. |
| 2 w 37° C. | 3.3 | n.a. | n.a. | n.a. | n.a. |
| 4 w 37° C. | 3.5 | n.a. | n.a. | n.a. | n.a. |
| % M829 oxidation (hALB) | | | | | |
| T0 | 8.9 | n.a. | n.a. | n.a. | n.a. |
| 2 w 37° C. | 42.9 | n.a. | n.a. | n.a. | n.a. |
| 4 w 37° C. | 44.1 | n.a. | n.a. | n.a. | n.a. | n.a. = not applicable;
n.t. = not tested

Example 5

Target A-hALB, -hFc, -scFc antibody construct formulated as described under Example 4 were subjected to a pH jump experiment. The concentration of the starting materials was 1.0 mg/mL. A volume of 0.38 mL of each starting material was filled in a glass vial. After preconditioning at 37° C. the solutions were spiked with 20 fold phosphate buffered saline (PBS) which was composed of 0.090 M potassium phosphate, 0.480 M sodium phosphate (both dibasic), 0.052 M potassium chloride and 2.76 M NaCl. The spiked samples were incubated at 37° C. for two weeks. After incubation they were analyzed by SE-UPLC using the method described under Example 4 and the percentaged content of HMWS was reported (Table 10). When comparing all constructs formulated in K60RTrT the HMWS content increased in the following order: hALB<scFc<hFc. Target A-scFc also showed a lower HMWS content than Target A-hFc when formulated in G40MSuT.

TABLE 10

Overview on HMWS contents in stressed (pH jump + 2 w 37° C.) Target A-hALB, -hFc, and -scFc antibody construct preparations determined via SE-UPLC

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | % HMWS | | | | |
| 2 w 37° C. | 1.5 | 8.3 | 7.1 | 5.4 | 5.1 |

Example 6

Target A-hALB, -hFc, and -scFc antibody construct formulated as described under Example 4 were subjected to agitation stress. The concentration of the starting materials was 1.0 mg/mL. A volume of 0.5 mL of each solution was filtered through an appropriate 0.22 μm filter and filled into 3 cc glass vials. The vials were placed in a plastic box ensuring that the vials were not displaced within the box during agitation. The box was placed onto an orbital shaker. The samples were agitated at 500 rpm for 65 hours. Visual particles were assessed in accordance to the method described by Ph Eur 2.9.20. The method was conducted by trained operators. Visual particle counts per vial are depicted in Table 11. Visible proteinaceous particles were only observed in Target A-hFc preparations.

TABLE 11

Number of visual proteinaceous particles per vial in agitated samples

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | Number of visible (>125 μm) proteinaceous particles per vial | | | | |
| 65 h, 500 rpm | 0 | 1 | 1 | 0 | 0 |

Above samples were also analyzed by size exclusion ultra-high performance chromatography (SE-UPLC) in order to quantify the percentaged content of high molecular weight species (HMWS). The same method as described in Example 4 was applied. The HMWS contents of agitated samples are outlined by Table 12. The formation of HMWS was most pronounced in Target A-hFc antibody construct when comparing K60RTrT preparations. HMWS were more abundant in Target A-hFc than in Target A-scFc.

TABLE 12

Overview on HMWS contents in stressed (pH jump + 2 w 37° C.) Target A-hALB, -hFc, and -scFc preparations determined via SE-UPLC

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | % HMWS | | | | |
| 65 h, 500 rpm | 1.8 | 5.8 | 2.4 | 1.8 | 0.3 |

Example 7

Target A-hALB, -hFc, and -scFc antibody construct formulated as described under Example 4 were exposed to visible and UVA light (photo stress). Protein concentration totaled 1 mg/mL in all preparations. Protein solutions were filtered through a filter with 0.22 µm pore size and filled to 0.5 mL in type I glass vials. Target A-hALB and -scFc were subjected to two different tests including 0.2 MLux visible light/25 W*h/m² UVA light and 1.2 MLux visible light/173 W*h/m² respectively. Target A-hFc was subjected to two different tests including 0.2 MLux visible light without UVA light and 1.2 MLux visible light/30 W*h/m² UVA light respectively. Chamber temperatures were adjusted to 25° C. After light exposure samples were analyzed by visible inspection (Table 13), SE-UPLC (Table 14) and peptide map (Table 15). Aforementioned methods were performed according to the procedures described under Example 4. Although Target A-hALB, and -scFc antibody construct were exposed to higher doses of UVA light, no visible proteinaceous particles was observed whereas Target A-hFc antibody construct samples exhibited one visible proteinaceous particle per vial for both tests irrespective of the formulation.

TABLE 13

Overview on the number of visible proteinaceous particles per vial in Target A-hALB, -hFc, and -scFc antibody construct preparations determined after light exposure

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | Number of visible (>125 µm) proteinaceous particles per vial | | | | |
| T0 | 0 | 0 | 1 | 0 | 0 |
| Test 1 | 0[1] | 1[2] | 1[2] | 0[1] | 0[1] |
| Test 2 | 0[3] | 1[4] | 1[4] | 0[3] | 0[3] |

[1] 0.2 MLux visible light/25 W*h/m² UVA light,
[2] 0.2 MLux visible light without UVA light,
[3] 1.2 MLux visible light/173 W*h/m²,
[4] 1.2 MLux visible light/30 W*h/m²

HMWS increased in the following order Target A-hALB<-scFc<-hFc antibody construct when the protein was formulated in K60RTrT. HMWS could be reduced for Fc based constructs when formulated in G40MSuT. However HMWS were again less pronounced for Target A-scFc. Target A-hFc antibody construct revealed to be especially sensitive towards UVA light exposure.

TABLE 14

Overview on HMWS contents in Target A-hALB, -hFc, and -scFc antibody construct preparations determined after light exposure via SE-UPLC

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | % HMWS | | | | |
| T0 | 1.8 | 6.7 | 3.3 | 2.5 | 1.3 |
| Test 1 | 1.8[1] | 6.3[2] | 2.5[2] | 2.1[1] | 0.4[1] |
| Test 2 | 2.0[3] | 11.0[4] | 2.1[4] | 2.4[3] | 0.3[3] |

[1] 0.2 MLux visible light/25 W*h/m² UVA light,
[2] 0.2 MLux visible light without UVA light,
[3] 1.2 MLux visible light/173 W*h/m²,
[4] 1.2 MLux visible light/30 W*h/m²

Percentages of chemical modifications of the complement determining regions (CDRs) and of the half-life extending portion (either hALB or Fc) detected in Target A-hALB, -hFc, and -scFc antibody construct preparations are given by Table 15. When comparing similar formulation conditions, it became obvious that overall, chemical modifications were least abundant in scFc constructs.

TABLE 15

Overview on chemical modifications in Target A-hALB, -hFc, and -scFc antibody construct preparations determined after light exposure via peptide mapping

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | % N101 deamidation (CDR) | | | | |
| T0 | 0.1 | 0.2 | 0.2 | 0.2 | 0.2 |
| Test 1 | 0.2[1] | n.t. | 0.3[2] | n.t. | 0.5[1] |
| Test 2 | 0.2[3] | n.t. | 0.6[4] | n.t. | 0.7[3] |
| | % N162 deamidation (CDR) | | | | |
| T0 | 3.0 | 1.7 | 1.9 | 2.3 | 2.5 |
| Test 1 | 3.0[1] | n.t. | 2.1[2] | n.t. | 2.7[1] |
| Test 2 | 3.6[3] | n.t. | 3.1[4] | n.t. | 2.8[3] |
| | % M279 oxidation (CDR) | | | | |
| T0 | 0.6 | 1.4 | 1.6 | 0.6 | 1.0 |
| Test 1 | 0.8[1] | n.t. | 2.6[2] | n.t. | 0.6[1] |
| Test 2 | 1.0[3] | n.t. | 6.3[4] | n.t. | 0.7[3] |
| | % N348 deamidation (CDR) | | | | |
| T0 | 0.5 | 3.2 | 3.3 | 0.5 | 0.9 |
| Test 1 | 0.4[1] | n.t. | 2.7[2] | n.t. | 0.2[1] |
| Test 2 | 0.9[3] | n.t. | 3.9[4] | n.t. | 0.2[3] |
| | % N351 deamidation (CDR) | | | | |
| T0 | 0.2 | 2.9 | 2.6 | 0.5 | 1.0 |
| Test 1 | 0.4[1] | n.t. | 2.0[2] | n.t. | 0.3[1] |
| Test 2 | 0.5[3] | n.t. | 2.6[4] | n.t. | 0.3[3] |
| | % M530 oxidation (Fc) | | | | |
| T0 | n.a. | 3.9 | 4.1 | 2.6 | 3.2 |
| Test 1 | n.a. | n.t. | 7.6[2] | n.t. | 3.1[1] |
| Test 2 | n.a. | n.t. | 21.8[4] | n.t. | 4.1[3] |

TABLE 15-continued

Overview on chemical modifications in Target A-hALB, -hFc, and -scFc antibody construct preparations determined after light exposure via peptide mapping

| | Construct | | | | |
|---|---|---|---|---|---|
| | hALB | hFc | | scFc | |
| | | Formulation | | | |
| | K60RTrT | K60RTrT | G40MSuT | K60RTrT | G40MSuT |
| | % M706 oxidation (Fc) | | | | |
| T0 | n.a. | 3.2 | 3.6 | 1.5 | 2.1 |
| Test 1 | n.a. | n.t. | 6.5[2)] | n.t. | 1.8[1)] |
| Test 2 | n.a. | n.t. | 17.8[4)] | n.t. | 2.7[3)] |
| | % M587 oxidation (hALB) | | | | |
| T0 | 1.0 | n.a. | n.a. | n.a. | n.a. |
| Test 1 | 1.5 | n.a. | n.a. | n.a. | n.a. |
| Test 2 | 2.4 | n.a. | n.a. | n.a. | n.a. |
| | % M623 oxidation (hALB) | | | | |
| T0 | 1.9 | n.a. | n.a. | n.a. | n.a. |
| Test 1 | 4.0 | n.a. | n.a. | n.a. | n.a. |
| Test 2 | 4.1 | n.a. | n.a. | n.a. | n.a. |
| | % M798 oxidation (hALB) | | | | |
| T0 | 1.4 | n.a. | n.a. | n.a. | n.a. |
| Test 1 | 2.1 | n.a. | n.a. | n.a. | n.a. |
| Test 2 | 3.1 | n.a. | n.a. | n.a. | n.a. |
| | % M829 oxidation (hALB) | | | | |
| T0 | 8.9 | n.a. | n.a. | n.a. | n.a. |
| Test 1 | 31.0 | n.a. | n.a. | n.a. | n.a. |
| Test 2 | 25.2 | n.a. | n.a. | n.a. | n.a. | n.a. = not applicable;
n.t. = not tested

Example 8

Target A-hALB antibody construct was formulated in K60RTrT and Target A-scFc antibody construct was formulated in G40MSuT according to the procedure described in Example 4. Protein concentrations totaled 0.05 mg/mL. Glass (borosilicate, type 1, 13 mm 3 cc vial from West, Art. No. 68000375) and polypropylene test containers (2 mL with O-ring, e.g. from Sarstedt, Art No. 72.694.005) are filled with 500 µL of the test solution. The test solution was left for five minutes in the first test container. Then a 150 µL aliquot was sampled for analysis. The remaining test solution (350 µL) was transferred sequentially from one test container to the next (five containers in total). In each vial, the solution was left for five minutes before the next transfer. The same pipette tip was used for each transfer step. The same test was performed using 30 mL polycarbonate bottles (Nalgene, PCS-000295 with closure, PP/20-415/ZTPE). For this container type the first container was filled with 5 mL. After a 150 µL aliquot was sampled, the residual volume was transferred from one test container to the next (according to the procedure described above). Samples pulled from container #1 and #5 were analyzed by SE-UPLC (method as described under Example 4). In addition protein detection was carried out with a PDA detector (280 nm) in order to determine protein concentrations. Percentaged protein recovery from each test container is given by Table 16. It was shown that protein recovery was more pronounced for Target A-scFc antibody construct than for Target A-hALB antibody construct irrespective of the container type.

TABLE 16

Protein recovery from different container types for Target A-hALB, and -scFc antibody construct determined by SE-UPLC

| | Construct | |
|---|---|---|
| | hALB | scFc |
| | Formulation | |
| | K60RTrT | G40MSuT |
| % Protein recovery (from nominal) | | |
| Type I glass | 80.0 | 92.0 |
| Polypropylene | 87.0 | 97.3 |
| Polycarbonate | 87.0 | 96.0 |

Example 9

Target A-hALB antibody construct was formulated in K60RTrT and Target A-scFc antibody construct was formulated in K60RTrT and G40MSuT according to the procedure described in Example 4. The protein concentration totaled 1.0 mg/mL. 1950 µL of each test solution was spiked with 50 µL of a 1000 ppm silicon standard solution (Specpure from AlfaAesar, Art. No. 38717) resulting in a 25 ppm spike. An unspiked test solution served as control sample. The spiked test solution as well as the control sample were filled into 3 cc type I glass vials and were incubated at 37° C. for 24 hours. All samples were analyzed by SE-UPLC according to the method described in Example 4 in order to quantify the amount of HMWS (Table 17).

TABLE 17

Overview on HMWS contents in Target A-hALB, and -scFc preparations determined via SE-UPLC after spiking with 25 ppm silicon

| | Construct | | |
|---|---|---|---|
| | hALB | scFc | |
| | Formulation | | |
| | K60RTrT | K60RTrT | G40MSuT |
| Δ % HMWS (compared to unspiked control) | | | |
| 25 ppm spike | 1.0 | 1.0 | 0.2 |

Example 10

Preformulated drug substances containing purified Target C (cc)-hALB, Target C (cc)-hFc, and Target C (cc)-scFc antibody constructs respectively were buffer exchanged via ultrafiltration/diafiltration using membranes with a molecular weight cut-off (MWCO) of 10 kDa. Final formulation was achieved by adding concentrated stock solutions. Resulting formulations for each construct are listed in Table 18. The target protein concentration was 1.0 mg/mL. Formulated Target C (cc)-constructs were filled to 1 mL in type I glass vials which were stoppered with butyl rubber stoppers and crimped with aluminum seals. Filled vials were incubated at −20, 5, 25 and 37° C. One vial of each version was subjected to five freeze and thaw (F/T) cycles. Target freezing temperature was −29° C. Target thawing temperature was 2° C. The ramp rate was approximately 0.3 K/min. The samples described above were also analyzed by size exclusion ultra-high performance chromatography (SE-UPLC) in order to quantify the percentage content of high molecular weight species (HMWS). SE-UPLC was performed according to the method described under Example 4. When formulated in K60RTrT, HMWS increased in the following order in unstressed samples: scFc<hALB<hFc. The least pronounced increase in HMWS upon freeze thaw stress was observed for the scFc-construct. The hFc-antibody construct revealed to be most prone to HMWS formation at −20° C. HMWS contents increased after four weeks storage at 5° C. The HMWS formation under these conditions was more pronounced for Fc based constructs than for albumin based constructs. In K60RTrT no significant increases in HMWS were observed at elevated storage temperatures (25 and 37° C.). When formulated in G40MSuT, all constructs revealed similar HMWS contents in unstressed samples. The increase during freeze thaw was more distinct for Fc based constructs if compared to the albumin based construct. In G40MSuT, the hFc-construct was least stable during storage at −20° C. Considerable increases in HMWS during liquid storage were only observed for the hALB-construct.

TABLE 18

Overview on HMWS contents in stressed and unstressed (T0) Target C (cc)-hALB, -hFc, and -scFc antibody construct preparations determined via SE-UPLC

| | Construct | | | | | |
|---|---|---|---|---|---|---|
| | hALB | | hFc | | scFc | |
| | Formulation | | | | | |
| | K60RTrT | G40MSuT | K60RTrT | G40MSuT | K60RTrT | G40MSuT |
| | % HMWS | | | | | |
| T0 | 1.5 | 0.3 | 2.7 | 0.3 | 1.3 | 0.3 |
| 5 F/T cycles | 2.0 | 0.5 | 3.1 | 0.7 | 1.6 | 0.7 |
| 2 w −20° C. | n.t | n.t | n.t | n.t | 1.5 | 0.5 |
| 2 w 5° C. | n.t | n.t | n.t | n.t | 1.8 | 0.2 |
| 2 w 25° C. | 1.7 | 0.6 | 2.3 | 0.2 | 1.3 | 0.2 |
| 2 w 37° C. | 1.9 | 0.7 | 1.8 | 0.2 | 1.2 | 0.2 |
| 4 w −20° C. | 1.6 | 0.4 | 4.2 | 1.5 | 1.7 | 0.9 |
| 4 w 5° C. | 1.9 | 0.3 | 3.3 | 0.3 | 2.1 | 0.4 |
| 4 w 25° C. | 1.4 | 0.6 | 2.2 | 0.2 | 1.4 | 0.4 |
| 4 w 37° C. | 1.3 | 0.7 | 2.0 | 0.1 | 1.4 | 0.3 | n.t. = not tested

The abundance of chemical modifications upon heat stress (incubation at 37° C.) was monitored by peptide mapping according to the method described in Example 4. Percentages of chemical modifications of the complement determining regions (CDRs) detected in Target C (cc)-hALB, -hFc, and -scFc preparations are given by Table 19. Overall, Target C (cc)-scFc exhibited the lowest amount of chemical modifications in the CDRs. It became evident that especially deamidations of the CDRs were least pronounced for the scFc construct.

TABLE 19

Overview on chemical modifications in stressed and unstressed (T0) Target C (cc)-hALB, -hFc, and -scFc antibody construct preparations determined via peptide mapping

| | Construct | | | | | |
|---|---|---|---|---|---|---|
| | hALB | | hFc | | scFc | |
| | Formulation | | | | | |
| | K60RTrT | G40MSuT | K60RTrT | G40MSuT | K60RTrT | G40MSuT |
| | % M34 oxidation (CDR) | | | | | |
| T0 | 1.0 | 1.8 | 1.0 | 1.4 | 1.7 | 1.9 |
| 2 w 37° C. | 0.9 | 1.3 | 0.9 | 1.1 | 1.0 | 1.7 |
| 4 w 37° C. | n.t. | n.t. | n.t. | 1.6 | n.t. | 1.8 |
| | % D103 isomerization (CDR) | | | | | |
| T0 | 0.8 | 0.8 | 0.8 | 0.8 | 0.6 | 0.6 |
| 2 w 37° C. | 4.0 | 4.6 | 4.5 | 4.4 | 5.8 | 7.3 |
| 4 w 37° C. | n.t. | n.t. | n.t. | 8.0 | n.t. | 12.4 |
| | % M290 oxidation (CDR) | | | | | |
| T0 | 0.7 | 1.4 | 0.8 | 1 | 1.3 | 1.4 |
| 2 w 37° C. | 0.7 | 1.0 | 0.8 | 0.8 | 0.8 | 1.3 |
| 4 w 37° C. | n.t. | n.t. | n.t. | 1.2 | n.t. | 1.6 |

TABLE 19-continued

Overview on chemical modifications in stressed and unstressed (T0) Target C (cc)-hALB, -hFc, and -scFc antibody construct preparations determined via peptide mapping

| | Construct | | | | | |
|---|---|---|---|---|---|---|
| | hALB | | hFc | | scFc | |
| | Formulation | | | | | |
| | K60RTrT | G40MSuT | K60RTrT | G40MSuT | K60RTrT | G40MSuT |
| | % N359 deamidation (CDR) | | | | | |
| T0 | 5.8 | 11.4 | 5.3 | 6.3 | 0.4 | 0.5 |
| 2 w 37° C. | 19.3 | 5.8 | 11.2 | 2.8 | 7.0 | 0.9 |
| 4 w 37° C. | n.t. | n.t. | n.t. | 2.9 | n.t. | 2.2 |
| | % N362 deamidation (CDR) | | | | | |
| T0 | 5.4 | 8.7 | 3.9 | 4.0 | 0.2 | 0.3 |
| 2 w 37° C. | 13.5 | 3.6 | 6.7 | 1.2 | 3.1 | 0.3 |
| 4 w 37° C. | n.t. | n.t. | n.t. | 1.4 | n.t. | 0.7 | n.a. = not applicable;
n.t. = not tested

Example 11

Target C (cc)-hALB, -hFc, and -scFC antibody constructs formulated as described under Example 4 were subjected to a pH jump experiment. The concentration of the starting materials was 1.0 mg/mL. A volume of 0.38 mL of each starting material was filled in a glass vial. After preconditioning at 37° C. the solutions were spiked with 20 fold phosphate buffered saline (PBS) which was composed of 0.090 M potassium phosphate, 0.480 M sodium phosphate (both dibasic), 0.052 M potassium chloride and 2.76 M NaCl. The spiked samples were incubated at 37° C. for two weeks. After incubation they were analyzed by SE-UPLC using the method described under Example 4 and the percentaged content of HMWS was reported (Table 20). Target C (cc)-scFc constructs showed the lowest HMWS content after pH jump if compared to Target C (cc)-hALB and -hFc irrespective of the formulation.

TABLE 20

Overview on HMWS contents in stressed (pH jump + 2 w 37° C.) Target C (cc)-hALB, -hFc, and -scFc antibody construct preparations determined via SE-UPLC

| | Construct | | | | | |
|---|---|---|---|---|---|---|
| | hALB | | hFc | | scFc | |
| | Formulation | | | | | |
| | K60RTrT | G40MSuT | K60RTrT | G40MSuT | K60RTrT | G40MSuT |
| | % HMWS | | | | | |
| 2 w 37° C. | 1.7 | 4.8 | 1.6 | 1.8 | 1.1 | 1.5 |

Example 12

Target C (cc)-hALB, -hFc, and -scFc antibody constructs formulated as described under Example 10 were subjected to agitation stress. The concentration of the starting materials was 1.0 mg/mL. A volume of 0.5 mL of each solution was filter through an appropriate 0.22 μm filter and filled into 3 cc type I glass vials. The vials were placed in a plastic box ensuring that the vials were not displaced within the box during agitation. The box was placed onto an orbital shaker. The samples were agitated at 500 rpm for 65 hours. Samples were analyzed by SE-UPLC in order to quantify the percentaged content of high molecular weight species (HMWS). The same method as described in Example 4 was applied. The HMWS contents of agitated samples are outlined by Table 21. The formation of HMWS was least pronounced for Target C (cc)-scFc in either formulation.

TABLE 21

Overview on HMWS contents in stressed (pH jump + 2 w 37° C.) Target C (cc)-hALB, -hFc, and -scFc antibody construct preparations determined via SE-UPLC

| | Construct | | | | | |
|---|---|---|---|---|---|---|
| | hALB | | hFc | | scFc | |
| | Formulation | | | | | |
| | K60RTrT | G40MSuT | K60RTrT | G40MSuT | K60RTrT | G40MSuT |
| | % HMWS | | | | | |
| 65 h, 500 rpm | 2.1 | 0.8 | 2.3 | 0.4 | 1.3 | 0.2 |

Example 13

Target C (cc)-hALB, -hFc, and -scFc antibody constructs formulated as described under Example 4 were exposed to visible and UVA light (photo stress). Protein concentration totaled 1 mg/mL in all preparations. Protein solutions were filtered through a filter with 0.22 µm pore size and filled to 0.5 mL in type I glass vials. Target C (cc)-hALB and -scFc were subjected to two different tests including 0.2 MLux visible light/25 W*h/m² UVA light and 1.2 MLux visible light/173 W*h/m² respectively. Target C (cc)-hFc was subjected to two different tests including 0.2 MLux visible light without UVA light and 1.2 MLux visible light/30 W*h/m² UVA light respectively. Chamber temperatures were adjusted to 25° C. After light exposure samples were analyzed by SE-UPLC (Table 22) and peptide map (Table 23). Aforementioned methods were performed according to the procedures under Example 4. Despite of the higher UVA light intensity applied to Target C (cc)-scFc, this construct was stable against HMWS formation. In contrast, Target C (cc)-hFc and Target C (cc)-hALB showed an increase in HMWS upon test 2 conditions.

TABLE 22

Overview on HMWS contents in Target C (cc)-hALB, -hFc, and -scFc antibody construct preparations determined after light exposure via SE-UPLC

| | Construct | | | | | |
|---|---|---|---|---|---|---|
| | hALB | | hFc | | scFc | |
| | Formulation | | | | | |
| | K60RTrT | G40MSuT | K60RTrT | G40MSuT | K60RTrT | G40MSuT |
| | % HMWS | | | | | |
| T0 | 1.5 | 0.3 | 2.7 | 0.3 | 1.3 | 0.3 |
| Test 1 | 1.8[1] | 0.3[1] | 2.5[2] | 0.3[2] | 1.4[1] | 0.3[1] |
| Test 2 | 4.6[3] | 1.1[3] | 6.0[4] | 0.7[4] | 1.5[3] | 0.3[3] |

[1] 0.2 MLux visible light/25 W * h/m² UVA light,
[2] 0.2 MLux visible light without UVA light,
[3] 1.2 MLux visible light/173 W * h/m²,
[4] 1.2 MLux visible light/30 W * h/m²

Overall chemical modifications upon light exposure were least pronounced for Target C (cc)-scFc. Especially deamidations of the CDRs were formed to a higher extent in Target C (cc)-hALB and Target C (cc)-hFc. When comparing Fc based constructs it was revealed that Target C (cc)-scFc was less prone to chemical modifications of the Fc portion although the scFc construct was exposed to higher UVA light doses than the hFc-construct. Table 23 also lists the most abundant chemical modifications of the albumin portion in Target C (cc)-hALB demonstrating that the half-life extending portion of this construct was chemically more degraded than the Fc portions of Target C (cc)-hFc and -scFc antibody construct.

TABLE 23

Overview on chemical modifications in Target C (cc)-hALB, -hFc, and -scFc antibody construct preparations determined after light exposure via peptide mapping

| | \multicolumn{6}{c}{Construct} | | | | | |
|---|---|---|---|---|---|---|
| | hALB | | hFc | | scFc | |
| | \multicolumn{6}{c}{Formulation} | | | | | |
| | K60RTrT | G40MSuT | K60RTrT | G40MSuT | K60RTrT | G40MSuT |
| \multicolumn{7}{c}{% M34 oxidation (CDR)} | | | | | | |
| T0 | 1.0 | 1.8 | 1.0 | 1.4 | 1.7 | 1.9 |
| Test 1 | 1.5[1] | n.t. | 0.7[2] | 4.2[2] | 1.4[1] | 1.2[1] |
| Test 2 | 1.7[3] | n.t. | 1.1[4] | 4.2[4] | 1.3[3] | 1.7[3] |
| \multicolumn{7}{c}{% D103 isomerization (CDR)} | | | | | | |
| T0 | 0.8 | 0.8 | 0.8 | 0.8 | 0.6 | 0.6 |
| Test 1 | 0.8[1] | n.t. | 0.9[2] | 0.9[2] | 0.8[1] | 1.0[1] |
| Test 2 | 1.1[3] | n.t. | 1.2[4] | 1.4[4] | 1.0[3] | 1.3[3] |
| \multicolumn{7}{c}{% M290 oxidation (CDR)} | | | | | | |
| T0 | 0.7 | 1.4 | 0.8 | 1 | 1.3 | 1.4 |
| Test 1 | 1.1[1] | n.t. | 0.5[2] | 3.3[2] | 1.0[1] | 0.9[1] |
| Test 2 | 1.4[3] | n.t. | 1.1[4] | 4.2[4] | 1.0[3] | 1.4[3] |
| \multicolumn{7}{c}{% N359 deamidation (CDR)} | | | | | | |
| T0 | 5.8 | 11.4 | 5.3 | 6.3 | 0.4 | 0.5 |
| Test 1 | 10.8[1] | n.t. | 4.5[2] | 5.6[2] | 0.4[1] | 0.2[1] |
| Test 2 | 12.4[3] | n.t. | 10.3[4] | 3.6[4] | 0.6[3] | 0.2[3] |
| \multicolumn{7}{c}{% N362 deamidation (CDR)} | | | | | | |
| T0 | 5.4 | 8.7 | 3.9 | 4.0 | 0.2 | 0.3 |
| Test 1 | 8.8[1] | n.t. | 3.4[2] | 3.5[2] | 0.3[1] | 0.3[1] |
| Test 2 | 9.8[3] | n.t. | 6.4[4] | 2.3[4] | 0.5[3] | 0.3[3] |
| \multicolumn{7}{c}{% D510 isomerization (Fc)} | | | | | | |
| T0 | n.a. | n.a. | 0.4 | 0.4 | 0.5 | 0.4 |
| Test 1 | n.a. | n.a. | 0.4[2] | 0.6[2] | 0.6[1] | 0.5[1] |
| Test 2 | n.a. | n.a. | 0.7[4] | 0.7[4] | 0.7[3] | 0.7[3] |
| \multicolumn{7}{c}{% M541 oxidation (Fc)} | | | | | | |
| T0 | n.a. | n.a. | 2.8 | 3 | 3.7 | 4.1 |
| Test 1 | n.a. | n.a. | 5.0[2] | 0.7[2] | 3.8[1] | 3.8[1] |
| Test 2 | n.a. | n.a. | 17.5[4] | 18.4[4] | 4.8[3] | 5.5[3] |
| \multicolumn{7}{c}{% N614 deamidation (Fc)} | | | | | | |
| T0 | n.a. | n.a. | 1.2 | 1.2 | 1.6 | 1.5 |
| Test 1 | n.a. | n.a. | 1.3[2] | 1.7[2] | 2.8[1] | 2.2[1] |
| Test 2 | n.a. | n.a. | 6.1[4] | 1.9[4] | 1.9[3] | 2.3[3] |
| \multicolumn{7}{c}{% N673 deamidation (Fc)} | | | | | | |
| T0 | n.a. | n.a. | 0.3 | 0.3 | 0.0 | 0.0 |
| Test 1 | n.a. | n.a. | 0.5[2] | 0.6[2] | 0.5[1] | 0.6[1] |
| Test 2 | n.a. | n.a. | 0.5[4] | 0.6[4] | 0.5[3] | 1.5[3] |
| \multicolumn{7}{c}{% M717 oxidation (Fc)} | | | | | | |
| T0 | n.a. | n.a. | 2.1 | 2.4 | 2.5 | 2.8 |
| Test 1 | n.a. | n.a. | 4.1[2] | 7.3[2] | 2.2[1] | 2.3[1] |
| Test 2 | n.a. | n.a. | 13.7[4] | 13.5[4] | 2.8[3] | 3.8[3] |
| \multicolumn{7}{c}{% M598 oxidation (hALB)} | | | | | | |
| T0 | 1.0 | n.t. | n.a. | n.a. | n.a. | n.a. |
| Test 1 | 2.3[1] | n.t. | n.a. | n.a. | n.a. | n.a. |
| Test 2 | 6.4[3] | n.t. | n.a. | n.a. | n.a. | n.a. |
| \multicolumn{7}{c}{% M809 oxidation (hALB)} | | | | | | |
| T0 | 1.8 | n.t. | n.a. | n.a. | n.a. | n.a. |
| Test 1 | 3.5[1] | n.t. | n.a. | n.a. | n.a. | n.a. |
| Test 2 | 8.3[3] | n.t. | n.a. | n.a. | n.a. | n.a. |
| \multicolumn{7}{c}{% M840 oxidation (hALB)} | | | | | | |
| T0 | 12.8 | n.t. | n.a. | n.a. | n.a. | n.a. |
| Test 1 | 32.0[1] | n.t. | n.a. | n.a. | n.a. | n.a. |
| Test 2 | 61.7 | n.t. | n.a. | n.a. | n.a. | n.a. |

TABLE 23-continued

Overview on chemical modifications in Target C (cc)-hALB, -hFc, and -scFc antibody construct preparations determined after light exposure via peptide mapping

| | Construct | | | | | |
|---|---|---|---|---|---|---|
| | hALB | | hFc | | scFc | |
| | | | Formulation | | | |
| | K60RTrT | G40MSuT | K60RTrT | G40MSuT | K60RTrT | G40MSuT |
| | % K1036 glycation (hALB) | | | | | |
| T0 | 10.1 | n.t. | n.a. | n.a. | n.a. | n.a. |
| Test 1 | 10.2[1)] | n.t. | n.a. | n.a. | n.a. | n.a. |
| Test 2 | 9.9[3)] | n.t. | n.a. | n.a. | n.a. | n.a. |

[1)] 0.2 MLux visible light/25 W * h/m² UVA light,
[2)] 0.2 MLux visible light without UVA light,
[3)] 1.2 MLux visible light/173 W * h/m²,
[4)] 1.2 MLux visible light/30 W * h/m²

Example 14

Different BiTE® antibody constructs designed for targeting Target C including Target C-non half-life extended (non HLE, "canonical"), Target C-hALB (comprising human serum albumin), and Target C-scFc (comprising a scFC modality as third domain as described above) were formulated in a solution comprising 100 mM L-arginine hydrochloride, 8% (w/v) Trehalose dihydrate and Polysorbate 80. The target protein concentration was 1.0 mg/mL for the hALB and scFc and 0.4 mg/mL for the non HLE version. Formulated BITE® antibody constructs were filled to 1 mL in type I glass vials which were stoppered with butyl rubber stoppers and crimped with aluminum seals. Filled vials were incubated at −20° C. and 37° C. (w/o and with 25 ppm silicon which is known for its potential to induce aggregation of proteins) for 4 weeks. Above constructs were also exposed to light (1.2 MLux visible light/173 W*h/m2 UVA light). For light stress, chamber temperature was set to 25° C. Samples stored at −70° C. served as controls (T0).

The samples described above were analyzed in duplicates by size exclusion ultra-high performance chromatography (SE-UPLC) in order to quantify the percentaged content of high molecular weight species (HMWS). SE-UPLC was performed on an Aquity H-Class UPLC system (Waters) using an Acquity UPLC BEH200 SEC 150 mm column (Waters). Column temperature was set to 25° C. Separation of size variants was achieved by applying an isocratic method with a flow rate of 0.4 mL/min. The mobile phase was composed of 100 mM sodium phosphate, 250 mM NaCl pH 6.8. The run time totals 6.0 minutes. Samples were held at 8° C. within the autosampler until analysis. A total amount of 3 μg protein was injected. In order to avoid carry over an intermediate injection with 40% ACN was performed after each sample. Detection was based on fluorescence (excitation at 280 nm, emission at 325 nm). Peak integration was performed using Empower® software. Relative area under the curve of HMWS was reported (24).

Within non-stressed samples, HMWS were least pronounced for the scFc-construct. HMWS formation was exclusively observed during 4 weeks storage at −20° C. The HMWS contents under these conditions increase in the following order scFc<hALB<non HLE.

TABLE 24

Overview on HMWS contents in stressed and unstressed (T0) Target C-non HLE, -hALB, and -scFc preparations determined via SE-UPLC.

| | Construct | | |
|---|---|---|---|
| | Non HLE (canonical) | hALB | scFc |
| T0 | 1.3% | 1.3% | 1.0% |
| 4 w −20° C. | 4.6% | 1.8% | 1.6% |
| 4 w 37° C. | 0.9% | 0.6% | 0.5% |
| 4 w 37° C. (25 ppm silicon) | 1.1% | 0.8% | 0.8% |
| Light exposure | 1.0% | 0.9% | 0.5% |

Additionally, samples derived from heat stress in absence and presence of silicon were assessed for the abundance of subvisible particles by Microfluid Imaging (MFI) using a Flowcam from Fluid Imaging Technologies, Inc. The instrument was equipped with a FC80FV flow cell. A tenfold optical magnification was applied. System suitability was verified with particle free water. An autoimage rate of 20 frames per second was applied. Dark and light thresholds were set to 25 and 20 pixels respectively. Sample volume for a single measurement totals 0.25 mL. Samples were measured in triplicates. Prior to each triplicate the system was flushed of 0.5 mL of the respective sample solutions. At the beginning and between each triplicate a wash with 1.0 mL particle free water was performed. Data evaluation was performed with Visual Spreadsheet software. Samples were measured in triplicates. Results are outlined in Table 25.

Heat stress resulted in subvisible particle formation in preparations containing non HLE and hALB constructs. In contrast, the scFc construct remained stable. Subvisible particle formation was not promoted by the addition of silicon independent on the nature of the BiTE® antibody construct.

TABLE 15

Assessment of subvisible particles by MFI in Target F-non HLE (canonical), -hALB, and -scFc preparations after heat stress in absence and presence of silicon.

| | Construct | | | | | | | | | | | |
|---|---|---|---|---|---|---|---|---|---|---|---|---|
| | Non HLE (canonical) | | | | hALB | | | | scFc | | | |
| | | | | | Particle size [μm] | | | | | | | |
| | ≥2 | ≥5 | ≥10 | ≥25 | ≥2 | ≥5 | ≥10 | ≥25 | ≥2 | ≥5 | ≥10 | ≥25 |
| T0 | 146 | 35 | 12 | 0 | 281 | 71 | 35 | 0 | 298 | 150 | 33 | 0 |
| 4 w 37° C. | 410 | 163 | 23 | 0 | 742 | 225 | 11 | 0 | 110 | 44 | 0 | 0 |
| 4 w 37° C. (25 ppm silicon) | 69 | 35 | 11 | 0 | 272 | 91 | 34 | 0 | 146 | 55 | 11 | 0 |

Samples from heat stress were also analyzed by Weak Cation Exchange (WCX) chromatography in order to quantify the percentaged content of charge variants using a UPLC Aquity H class from Waters. A Protein-Pak Hi Res CM 7im 4.6×100 mm column (Waters, cat No. 186004929) was applied. The column temperature was adjusted to 30° C. The flow rate was set to 0.65 mL/min. The applied gradient was designed as follows (Table 26). The temperature of the autosampler was kept at 2-8° C.

TABLE 26

Gradient applied for WCX chromatography

| Time [min:sec] | % A 20 mM sodium phosphate, pH 6.5 | % B 20 mM sodium phosphate, 250 mM sodium chloride, pH 6.5 |
|---|---|---|
| 00:00 | 100 | 0 |
| 04:00 | 100 | 0 |
| 25:00 | 50 | 50 |
| 25:01 | 0 | 100 |
| 29:00 | 0 | 100 |
| 29:01 | 100 | 0 |
| 33:00 | 100 | 0 |

A total amount of 3 μg of protein was injected. Detection was based on fluorescence (excitation at 280 nm, emission at 325 nm). Peak integration was performed using Empower® software. Relative areas under the curve of the main peak as well as of acidic and basic charge variants was reported (Table 27).

Heat stress resulted in a reduced main peak percentage which had to be attributed to a predominant formation of acidic charge variants. The loss in main peak percentage was least pronounced for the scFc construct (7.5%). Basic charge variants were formed in both constructs with extended half-life upon light exposure. The increase in basic charge variants ranged between 5 and 6% in hALB and scFc constructs.

TABLE 27

Assessment of charge variants by WCX chromatography in Target F-non HLE (canonical), -hALB, and -scFc preparations after heat and light induced stress.

| | Construct | | | | | | | | |
|---|---|---|---|---|---|---|---|---|---|
| | Non HLE (canonical) | | | hALB | | | scFc | | |
| | | | | Fraction | | | | | |
| | % main | % acidics | % basics | % main | % acidics | % basics | % main | % acidics | % basics |
| T0 | 89.9 | 3.6 | 6.5 | 83.3 | 0.7 | 16.0 | 74.5 | 3.4 | 22.1 |
| 4 w 37° C. | 79.3 | 11.1 | 9.5 | 75.6 | 9.8 | 14.6 | 67.0 | 11.2 | 21.8 |

In addition, sample purity was quantified in heat and light stressed samples using a microfluidic capillary electrophoresis sodium dodecylsulphate (CE-SDS) assay based on the LabChip GXII system (Perkin Elmer). The sample denaturing solution was composed of the HT Protein Express Sample Buffer (provided by Perkin Elmer) supplemented with 34 mM dithiothreitol. Each sample was diluted 1:8 with the denaturing solution and heated up to 70° C. for 10 minutes together with the protein express ladder. 35 μL of water for injection (WFI) were added to 40 μL of the denatured sample. 120 μL WFI were added to 12 μL of the ladder. Samples, ladder, protein express wash buffer, gel dye and destain solution are transferred to the respective reservoirs. Samples are electrokinetically loaded from a microtiter plate onto the chip integrating the separation, staining, destaining, and detection of the protein and its size variants. The resulting electropherograms were evaluated and changes in purity were reported. An overview on the percentaged purity detected post stress is given by Table 28 and compared to unstressed samples (T0).

Higher purities were observed for hALB and scFc constructs if compared to the non HLE construct under all conditions. Slight decreases in purity if compared to T0 were detected for hALB and scFc constructs upon heat and light stress. The loss in purity after 4 weeks storage at 37° C. totals 8.4% for the hALB construct and 6.6% for the scFc constructs. The losses upon light exposure were comparable between hALB and scFc.

TABLE 28

Overview on percentaged purity in stressed and unstressed (T0) Target F-non HLE, -hALB, and -scFc preparations determined via LabChip GXII (Caliper).

| | Construct | | |
|---|---|---|---|
| | Non HLE (canonical) | hALB | scFc |
| T0 | 57.4 | 96.0 | 92.2 |
| 4 w 37° C. | 60.6 | 87.6 | 85.6 |
| Light exposure | 61.5 | 90.1 | 86.4 |

Example 15

Different BiTE® antibody constructs designed for targeting Target D including Target D-hALB and Target D-scFc were formulated at pH 7.0. The target protein concentration was 1.0 mg/mL for both constructs. Formulated BiTE® antibody constructs were filled to 1 mL in type I glass vials which were stoppered with butyl rubber stoppers and crimped with aluminum seals. Filled vials were incubated at 37° C. (Target D-hALB) and 40° C. (Target D-scFc) for 4 weeks. Samples stored at −70° C. served as controls (T0). Samples were analyzed by SE-UPLC according to the method described under Example 14 Results are outlined in Table 29.

The scFc construct exhibited a reduced monomer loss (2.3%) upon heat stress if compared to the hALB construct (4.0%) although the incubation temperature was slightly higher.

TABLE 29

Overview on monomer peak percentage in stressed and unstressed (T0) Target D-hALB and -scFc preparations determined via SE-UPLC.

| | Construct | |
|---|---|---|
| | hALB | scFc |
| T0 | 97.6% | 99.8% |
| 4 w | 93.6% | 97.5% |

Example 16

Different BiTE® antibody constructs designed for targeting PSMA including PSMA-non HLE (canonical) and PSMA-scFc were examined. The target protein concentration was 1.0 mg/mL. Formulated BiTE® antibody constructs were filled to 1 mL in type I glass vials which were stoppered with butyl rubber stoppers and crimped with aluminum seals. Filled vials were incubated at −20° C. and 37° C. (w/o and with 25 ppm silicon) for 4 weeks. Above constructs were also exposed to light (1.2 MLux visible light/173 W*h/m² UVA light). For light stress chamber temperature was set to 25° C. Samples stored at −70° C. served as controls (T0). All samples were analyzed by SE-UPLC according to the method described under Example 14 Results are outlined in Table 30.

The scFc construct showed higher monomer contents than the non HLE construct under all tested stress conditions indicating a lower propensity to the formation of high (aggregates) or low molecular weight species (fragments) of the scFc construct.

TABLE 30

Overview on monomer contents in stressed and unstressed (T0) PSMA-non HLE and -scFc preparations determined via SE-UPLC.

| | Construct | |
|---|---|---|
| | Non-HLE (canonical) | scFc |
| T0 | 97.0% | 98.6% |
| 4 w −20° C. | 96.7% | 98.9% |
| 4 w 37° C. | 88.3% | 94.1% |
| 4 w 37° C. (25 ppm silicon) | 90.4% | 96.1% |
| Light exposure | 96.1% | 99.0% |

Additionally, samples derived from heat stress in absence and presence of silicon were assessed for the abundance of subvisible particles by Microfluid Imaging (MFI) using the method described under Example 14 Results are outlined in Table 31.

The scFc construct revealed a significantly lower abundance of subvisible particles than the non HLE construct when subjected to heat stress in absence and presence of silicon.

TABLE 31

Assessment of subvisible particles by MFI in PSMA-non HLE (canonical) and -scFc preparations after heat stress in absence and presence of silicon.

| | Construct | | | | | | | |
|---|---|---|---|---|---|---|---|---|
| | Non-HLE (canonical) | | | | scFc | | | |
| | Particle size [μm] | | | | | | | |
| | ≥2 | ≥5 | ≥10 | ≥25 | ≥2 | ≥5 | ≥10 | ≥25 |
| 4 w 37° C. | 4675 | 2334 | 1017 | 22 | 2518 | 1364 | 655 | 24 |
| 4 w 37° C. (25 ppm silicon) | 8249 | 4243 | 1906 | 34 | 965 | 473 | 179 | 11 |

Samples from heat and light stress were also analyzed by Weak Cation Exchange (WCX) chromatography in order to quantify the percentaged content of charge variants using a UPLC Aquity H class from Waters according to the method described under Example 14 Relative areas under the curve of the main peak as well as of acidic and basic charge variants was reported (Table 32).

The scFc construct showed higher main peak percentages (lower amount of charge variants) than the non HLE construct. This difference was most pronounced when comparing samples subjected to heat stress indicating a higher chemical stability of the scFc construct.

TABLE 32

Assessment of charge variants by WCX chromatography in PSMA-non HLE (canonical) and -scFc preparations after heat and light induced stress.

| | Construct | | | | | |
|---|---|---|---|---|---|---|
| | Non HLE (canonical) | | | scFc | | |
| | Fraction | | | | | |
| | % main | % acidics | % basics | % main | % acidics | % basics |
| T0 | 66.1 | 18.4 | 15.6 | 70.4 | 14.5 | 15.1 |
| 4 w 37° C. | 32.1 | 51.8 | 16.1 | 41.5 | 45.6 | 12.9 |
| Light exposure | 68.0 | 24.6 | 7.4 | 69.9 | 12.6 | 17.5 |

In addition, sample purity was quantified in heat and light stressed samples using a microfluidic capillary electrophoresis sodium dodecylsulphate (CE-SDS) assay based on the LabChip GXII system (Perkin Elmer) according to the method described under Example 14 An overview on the percentaged purity detected post stress is given by Table 33 and compared to unstressed samples (T0).

Higher purities were observed for the scFc construct if compared to the non HLE construct irrespective of the stress conditions. Hence, as exemplified hereby, scFc antibody constructs are more stable over a broad array of stress conditions than non-HLE antibody constructs and, thus, safer and better suited for versatile clinical employment with ever changing stress conditions in practice.

TABLE 33

Overview on percentaged purity in stressed and unstressed (T0) PSMA-non HLE, and -scFc preparations determined via LabChip GXII.

| | Construct | |
|---|---|---|
| | Non-HLE (canonical) | scFc |
| T0 | 89.2 | 100.0 |
| 4 w 37° C. | 85.4 | 87.3 |
| Light exposure | 89.5 | 93.8 |

Example 17

Different BiTE® antibody constructs designed for targeting Target B including Target B-Xbody and Target B-scFc were examined. The target protein concentration was 1.0 mg/mL. Formulated BiTE® antibody constructs were filled to 1 mL in type I glass vials which were stoppered with butyl rubber stoppers and crimped with aluminum seals. Filled vials were incubated at −20° C. and 37° C. for 4 weeks. Additionally, all samples were exposed to 1.2 MLux visible light and 173 W*h/m² UVA light. Chamber temperature was adjusted to 25° C. Samples stored at −70° C. served as controls (T0). Samples stored at −20 and −37° C. were analyzed by SE-UPLC according to the method described under Example 14 Results are outlined in Table 34.

The scFc construct preserved a higher monomer content when stored for four weeks at −20 and 37° C. respectively if compared to the Xbody.

TABLE 34

Overview on monomer contents in stressed and unstressed (T0) Target B-Xbody and -scFc preparations determined via SE-UPLC.

| | Construct | |
|---|---|---|
| | Xbody | scFc |
| T0 | 100.0 | 98.8 |
| 4 w −20° C. | 97.1 | 97.9 |
| 4 w 37° C. | 94.5 | 95.7 |

Additionally, unstressed samples were assessed for the abundance of subvisible particles by Microfluid Imaging (MFI) using the method described under Example 14 Results are outlined in Table 35. The CD19-scFc preparation exhibited significantly lower amounts of subvisible particles if compared to the CD19-Xbody preparation. This applies to all included size fractions.

TABLE 35

Assessment of subvisible particles by MFI in unstressed Target B-Xbody and -scFc

| | Construct | | | | | | | |
|---|---|---|---|---|---|---|---|---|
| | Xbody | | | | scFc | | | |
| | Particle size [µm] | | | | | | | |
| | ≥2 | ≥5 | ≥10 | ≥25 | ≥2 | ≥5 | ≥10 | ≥25 |
| T0 | 2648 | 688 | 192 | 32 | 160 | 64 | 43 | 11 |

Samples from light stress were also analyzed by Weak Cation Exchange (WCX) chromatography in order to quantify the percentaged content of charge variants using a UPLC Aquity H class from Waters according to the method described under Example 14 Relative areas under the curve of the main peak as well as of acidic and basic charge variants was reported (Table 36).

TABLE 36

Assessment of charge variants by WCX chromatography in Target B-Xbody and -scFc preparations after heat and light induced stress.

| | Construct | | | | | |
|---|---|---|---|---|---|---|
| | Xbody | | | scFc | | |
| | Fraction | | | | | |
| | % main | % acidics | % basics | % main | % acidics | % basics |
| T0 | 51.4 | 30.3 | 18.3 | 83.5 | 1.3 | 15.2 |
| Light exposure | 45.9 | 33.2 | 20.9 | 82.1 | 1.2 | 16.7 |

The scFc construct showed surprisingly enhanced stability against light exposure if compared to the Xbody indicated by a less pronounced loss in main peak which totaled 1.4% compared to 5.5% for the Xbody construct. Hence, it can derived from said exemplarily setting that an anti-PSMA antibody construct provided with a scFc domain as HLE is superior to other antibody constructs comprising different HLE in terms of stress resistance and, in consequence, features surprisingly improved stability.

Example 18 Size Exclusion Chromatography of Bispecific scFc Variants

Figure 6:
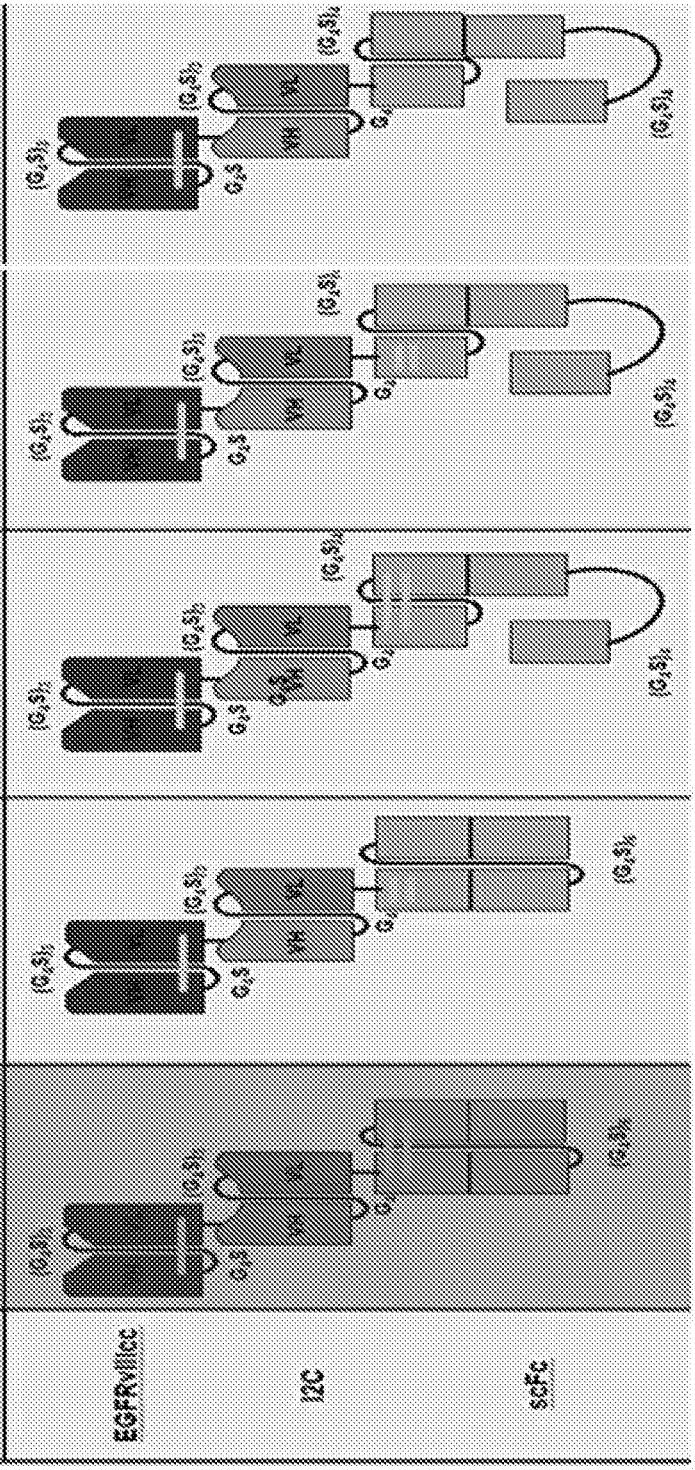
FIG. 6: Bispecific scFc variants D9F (SEQ ID NO: 481), T2G (SEQ ID NO: 482), D3L (SEQ ID NO: 483, 171 (SEQ ID NO: 484) and K6C (SEQ ID NO: 485). A preferred antibody construct of the present invention is shown in SEQ ID NO: 481.

The constructs D9F, T2G, D3L, T7I and K6C (see FIG. 6) were each tested for their running behavior by size exclusion chromatography according to standard procedures. In detail, a defined amount of 25 µg of each construct were run (at 750 µl/min) in Citrate Lysin Buffer (10 mM and 75 mM, pH7) on a Superdex 200 increase 10/300GL column at room temperature and the OD 280 nm was recorded. Subsequently, constructs have been compared by their retention times. As a result, construct D9F shows significantly delayed elution (Table 37) as compared to T2G, D3L, T7I and K6C, which indicates a difference in the structure/arrangement of the Fc domains. This difference in retention time was most significant with construct T7I having unpaired cysteines in the hinge region and the linkage of CH2 and CH2CH3 to CH3 (18.98 min vs. 18.62 min, difference of 0.36 min). However, also the difference in retention time of 0.16 min between D9F and T2G is significant taking the respective retention time of the BSA control into consideration. The BSA control showed a retention time of 19.07 min for the monomer and 16.82 min for the dimer displaying a difference of 2.25 min in retention time for a doubled molecular weight. Hence, as the constructs having only structural differences in the Fc part, 0.16 min difference in retention time are significant. In summary, construct D9F showed the longest retention time indicating the strongest binding. This conclusion leads to the expectation of D9F also has the longest half live in vivo.

TABLE 37

| Construct | Retention time in min |
|---|---|
| D9F | 18.98 |
| T2G | 18.82 |
| D3L | 18.78 |
| K6C | 18.77 |
| T7I | 18.62 |
| BSA monomer | 19.07 |
| BSA dimer | 16.82 |

Example 19: Surface Plasmon Resonance-Based Determination of Binding to Human FcRn (FCGRT/B2M)

The constructs D9F, T2G, D3L, T71 and K6C (FIG. 6) were each tested for their capability of binding against human FcRn in SPR (BIACORE™) experiments according to standard procedures. In detail, CM5 Sensor Chips (GE Healthcare) were immobilized with 450-500 RU of FCGRT/B2M (ACRO Biosystems) by using Na acetate buffer pH 4.5 and a running buffer consisting of 200 mM HEPES, 150 mM NaCl, 3 mM EDTA pH 6.0. The constructs were then injected in subsequent runs in two concentrations of 250 nM and 125 nM diluted in 200 mM HEPES, 150 mM NaCl, 3 mM EDTA, pH 6.0 and 36° C. Association was done for 90 seconds with a 30 µl/min flow rate followed by the dissociation phase for 90 seconds at a 30 µl/min flow rate in 200 mM HEPES, 150 mM NaCl, 3 mM EDTA, pH 6.0 at 36° C. Subsequent regeneration was done for 10 sec with 30 µl/min with 10 mM HEPES, 150 mM NaCl, 3 mM EDTA pH 7.4.

Figure 7A:
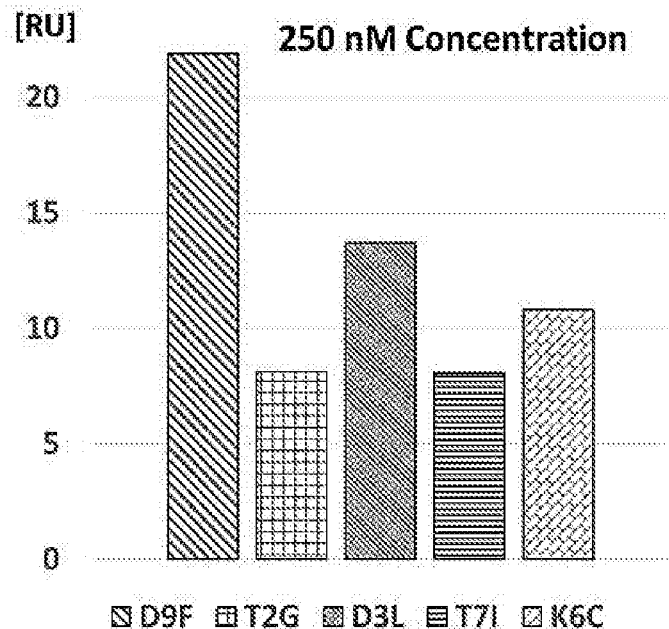
FIGS. 7A-7B: Surface Plasmon Resonance (SPR)-based determination of binding to human FcRn. Constructs D9F, T2G, D3L, T7I and K6C were each tested for their capability of binding against human FcRn in SPR (BIACORE™) experiments. The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted in FIGS. 7A and 7B.
Figure 7B:
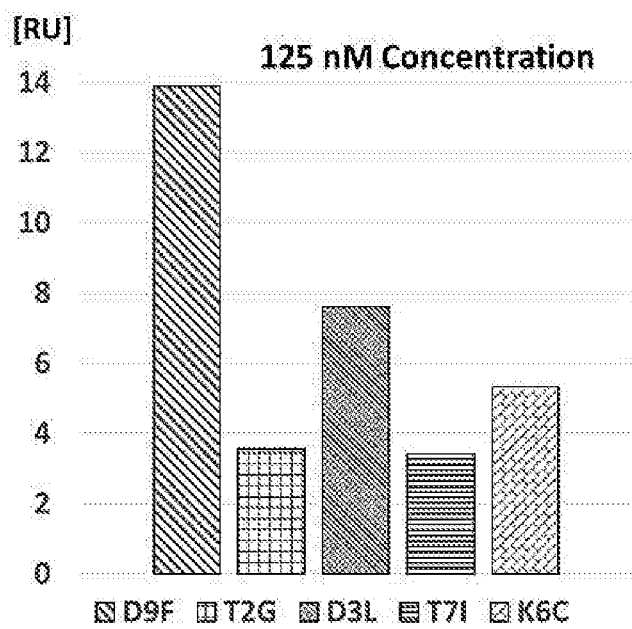

The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted in FIGS. 7A and 7B, respectively.

As a result, construct D9F shows significantly higher mass increase on the FcRn coated CM5 chip, as compared to T2G, D3L, T71 and K6C, which indicates stronger binding affinity of D9F to human FcRn. This observation was seen for both concentrations of the respective constructs.

The binding against FcRn is mediated through the Fc portion within the constructs. Stronger binding against human FcRn as described in the literature is an indicator for longer halflife in vivo due to a higher intracellular rescue of the respective protein and a therefore reduced degradation rate. For this reason, stronger binding of D9F to human FcRn as compared to the other constructs makes this molecule clearly superior as a basis for therapeutic molecules to allow for longer exposure of the potential drug in the patient and a lower frequency of drug administration.

Example 20: Surface Plasmon Resonance-Based Determination of Binding to Human FcRn (FCGRT/B2M)

The constructs D9F, T2G, D3L, T71 and K6C and a human IgG1-kappa antibody MT201 were each tested for their capability of binding against human FcRn in SPR (BIACORE™) experiments according to standard procedures. In detail, CM5 Sensor Chips (GE Healthcare) were immobilized with around 350 RU of FCGRT/B2M (ACRO Biosystems) by using Na acetate buffer pH 4.5 and a running buffer consisting of 200 mM HEPES, 150 mM NaCl, 3 mM EDTA pH 6.0. The constructs and the human IgG1-kappa control (MT201) were then injected at a concentration of 125 nM diluted in 200 mM HEPES, 150 mM NaCl, 3 mM EDTA, pH 6.0 and 36° C. Association was done for 90 seconds with a 30 µl/min flow rate followed by the dissociation phase for 60 seconds at a 30 µl/min flow rate in 200 mM HEPES, 150 mM NaCl, 3 mM EDTA, pH 6.0 at 36° C. Subsequent regeneration was done for 10 sec with 30 µl/min with 10 mM HEPES, 150 mM NaCl, 3 mM EDTA pH 7.4.

Figure 8:
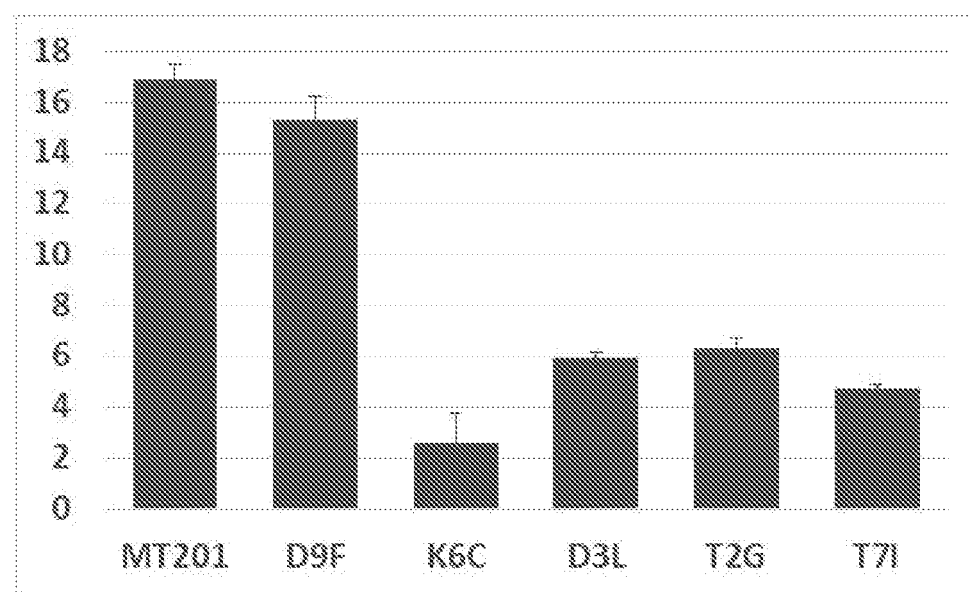
FIG. 8: The constructs D9F, T2G, D3L, T71 and K6C and a human IgG1-kappa antibody MT201 were each tested for their capability of binding against human FcRn in SPR (BIACORE™) experiments. The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted including standard deviation error bars

The maximal binding during the injection phase was measured for all constructs as the respective response units (RU), equivalent to the molecular mass increase on the FcRn coated CM5 chip due to bound construct. All constructs were measured in duplicates. Average values of the duplicate determinations are depicted in FIG. 8 including standard deviation error bars.

As a result, construct D9F shows significantly higher mass increase on the FcRn coated CM5 chip, as compared to T2G, D3L, T71 and K6C, which indicates stronger binding affinity of D9F to human FcRn. The mass increase on the FcRn-coated CM5 chip for D9F is well comparable to the mass increase of the human IgG1-kappa control antibody MT201, indicating a comparable binding of construct D9F to human FcRn.

The binding against FcRn is mediated through the human IgG1 Fc portion within the constructs. Stronger binding against human FcRn as described in the field is an indicator for longer half-life in vivo due to a higher intracellular rescue of the respective protein and a therefore reduced degradation rate. For this reason, stronger binding of D9F to human FcRn in the range of a human IgG1-kappa antibody (MT201), as compared to the other constructs makes this molecule clearly superior as a basis for therapeutic molecules to allow for longer exposure of the potential drug in the patient, presumably in the range of a full human IgG1 antibody, and a lower frequency of drug administration.

TABLE 38

Sequence Table

| SEQ ID NO: | Designation | Format/Source | Sequence |
|---|---|---|---|
| 1. | G4S linker | | GGGGS |
| 2. | (G4S)2 linker | | GGGGSGGGGS |
| 3. | (G4S)3 linker | | GGGGSGGGGSGGGGS |
| 4. | (G4S)4 linker | | GGGGSGGGGSGGGGSGGGGS |
| 5. | (G4S)5 linker | | GGGGSGGGGSGGGGSGGGGSGGGGS |
| 6. | (G4S)6 linker | | GGGGSGGGGSGGGGSGGGGSGGGGSGGGGS |
| 7. | (G4S)7 linker | | GGGGSGGGGSGGGGSGGGGSGGGGSGGGGSGGGGS |
| 8. | (G4S)8 linker | | GGGGSGGGGSGGGGSGGGGSGGGGSGGGGSGGGGSGGGGS |
| 9. | Peptide linker | | PGGGGS |
| 10. | Peptide linker | | PGGDGS |
| 11. | Peptide linker | | SGGGGS |
| 12. | Peptide linker | | GGGG |
| 13. | CD3ε binder VL | | QTVVTQEPSLTVSPGGTVTLTCGSSTGAVTSGNYPNWVQQKPGQAPR GLIGGTKFLAPGTPARFSGSLLGGKAALTLSGVQPEDEAEYYCVLWY SNRWVFGGGTKLTVL |
| 14. | CD3ε binder VH | | EVQLVESGGGLVQPGGSLRLSCAASGFTFNSYAMNWVRQAPGKGLEW VARIRSKYNNYATYYADSVKGRFTISRDDSKNTAYLQMNSLKTEDTA VYYCVRHGNFGNSYVSWWAYWGQGTLVTVSS |
| 15. | CD3ε binder scFv | | EVQLVESGGGLVQPGGSLRLSCAASGFTFNSYAMNWVRQAPGKGLEW VARIRSKYNNYATYYADSVKGRFTISRDDSKNTAYLQMNSLKTEDTA VYYCVRHGNFGNSYVSWWAYWGQGTLVTVSSGGGGSGGGGSGGGGSQ TVVTQEPSLTVSPGGTVTLTCGSSTGAVTSGNYPNWVQQKPGQAPRG LIGGTKFLAPGTPARFSGSLLGGKAALTLSGVQPEDEAEYYCVLWYS NRWVFGGGTKLTVL |
| 16. | hexa-histidine tag | | HHHHHH |
| 17. | Fc monomer-1 +c/-g | | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGK |
| 18. | Fc monomer-2 +c/-g/delGK | | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSP |
| 19. | Fc monomer-3 -c/+g | | DKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGK |
| 20. | Fc monomer-4 -c/+g/delGK | | DKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSP |
| 21. | Fc monomer-5 -c/-g | | DKTHTCPPCPAPELLGGPSVFLFPPKPKDTLMISRTPEVTCVVVDVS HEDPEVKFNWYVDGVEVHNAKTKPREEQYGSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGK |

TABLE 38-continued

Sequence Table

| SEQ ID NO: | Designation | Format/ Source | Sequence |
|---|---|---|---|
| 22. | Fc monomer-6 -c/-g/delGK | | DKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSP |
| 23. | Fc monomer-7 +c/+g | | DKTHTCPPCPAPELLGGPSVFLFPPKPKDTLMISRTPEVTCVVVDVS HEDPEVKFNWYVDGVEVHNAKTKPCEEQYNSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGK |
| 24. | Fc monomer-8 +c/+g/delGK | | DKTHTCPPCPAPELLGGPSVFLFPPKPKDTLMISRTPEVTCVVVDVS HEDPEVKFNWYVDGVEVHNAKTKPCEEQYNSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSP |
| 25. | scFc-1 | | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGKGGGGSGGG GSGGGGSGGGGSGGGGSGGGGSDKTHTCPPCPAPELLGGPSVFLFPPP KPKDTLMISRTPEVTCVVVDVSHEDPEVKFNWYVDGVEVHNAKTKPC EEQYGSTYRCVSVLTVLHQDWLNGKEYKCKVSNKALPAPIEKTISKA KGQPREPQVYTLPPSREEMTKNQVSLTCLVKGFYPSDIAVEWESNGQ PENNYKTTPPVLDSDGSFFLYSKLTVDKSRWQQGNVFSCSVMHEALH NHYTQKSLSLSPGK |
| 26. | scFc-2 | | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKP KDTLMISRTPEVTCVVVDVSHEDPEVKFNWYVDGVEVHNAKTKPCEE QYGSTYRCVSVLTVLHQDWLNGKEYKCKVSNKALPAPIEKTISKAKG QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 27. | scFc-3 | | DKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGKGGGGSGGG GSGGGGSGGGGSGGGGSDKTHTCPPCPAPELLGGPSVFLFPPP KPKDTLMISRTPEVTCVVVDVSHEDPEVKFNWYVDGVEVHNAKTKPR EEQYNSTYRVVSVLTVLHQDWLNGKEYKCKVSNKALPAPIEKTISKA KGQPREPQVYTLPPSREEMTKNQVSLTCLVKGFYPSDIAVEWESNGQ PENNYKTTPPVLDSDGSFFLYSKLTVDKSRWQQGNVFSCSVMHEALH NHYTQKSLSLSPGK |
| 28. | scFc-4 | | DKTHTCPPCPAPELLGGPSVFLFPPKPKDTLMISRTPEVTCVVVDVS HEDPEVKFNWYVDGVEVHNAKTKPREEQYNSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGGGGSGGGGS GGGGSGGGGSGGGGSDKTHTCPPCPAPELLGGPSVFLFPPKP KDTLMISRTPEVTCVVVDVSHEDPEVKFNWYVDGVEVHNAKTKPREE QYNSTYRVVSVLTVLHQDWLNGKEYKCKVSNKALPAPIEKTISKAKG QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 29. | scFc-5 | | DKTHTCPPCPAPELLGGPSVFLFPPKPKDTLMISRTPEVTCVVVDVS HEDPEVKFNWYVDGVEVHNAKTKPREEQYGSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGKGGGGSGGG GSGGGGSGGGGSGGGGSGGGGSDKTHTCPPCPAPELLGGPSVFLFPP KPKDTLMISRTPEVTCVVVDVSHEDPEVKFNWYVDGVEVHNAKTKPR EEQYGSTYRVVSVLTVLHQDWLNGKEYKCKVSNKALPAPIEKTISKA |

TABLE 38-continued

Sequence Table

| SEQ ID NO: | Designation | Format/ Source | Sequence |
|---|---|---|---|
| | | | KGQPREPQVYTLPPSREEMTKNQVSLTCLVKGFYPSDIAVEWESNGQ PENNYKTTPPVLDSDGSFFLYSKLTVDKSRWQQGNVFSCSVMHEALH NHYTQKSLSLSPGK |
| 30. | scFc-6 | | DKTHTCPPCPAPELLGGPSVFLFPPKPKDTLMISRTPEVTCVVVDVS HEDPEVKFNWYVDGVEVHNAKTKPREEQYGSTYRVVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKP KDTLMISRTPEVTCVVVDVSHEDPEVKFNWYVDGVEVHNAKTKPREE QYGSTYRVVSVLTVLHQDWLNGKEYKCKVSNKALPAPIEKTISKAKG QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 31. | scFc-7 | | DKTHTCPPCPAPELLGGPSVFLFPPKPKDTLMISRTPEVTCVVVDVS HEDPEVKFNWYVDGVEVHNAKTKPCEEQYNSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGKGGGGSGGG GSGGGGSGGGGSGGGGSGGGGSDKTHTCPPCPAPELLGGPSVFLFPP KPKDTLMISRTPEVTCVVVDVSHEDPEVKFNWYVDGVEVHNAKTKPC EEQYNSTYRCVSVLTVLHQDWLNGKEYKCKVSNKALPAPIEKTISKA KGQPREPQVYTLPPSREEMTKNQVSLTCLVKGFYPSDIAVEWESNGQ PENNYKTTPPVLDSDGSFFLYSKLTVDKSRWQQGNVFSCSVMHEALH NHYTQKSLSLSPGK |
| 32. | scFc-8 | | DKTHTCPPCPAPELLGGPSVFLFPPKPKDTLMISRTPEVTCVVVDVS HEDPEVKFNWYVDGVEVHNAKTKPCEEQYNSTYRCVSVLTVLHQDWL NGKEYKCKVSNKALPAPIEKTISKAKGQPREPQVYTLPPSREEMTKN QVSLTCLVKGFYPSDIAVEWESNGQPENNYKTTPPVLDSDGSFFLYS KLTVDKSRWQQGNVFSCSVMHEALHNHYTQKSLSLSPGGGGSGGGGS GGGGSGGGGSGGGGSGGGGSDKTHTCPPCPAPELLGGPSVFLFPPKP KDTLMISRTPEVTCVVVDVSHEDPEVKFNWYVDGVEVHNAKTKPCEE QYNSTYRCVSVLTVLHQDWLNGKEYKCKVSNKALPAPIEKTISKAKG QPREPQVYTLPPSREEMTKNQVSLTCLVKGFYPSDIAVEWESNGQPE NNYKTTPPVLDSDGSFFLYSKLTVDKSRWQQGNVFSCSVMHEALHNH YTQKSLSLSP |
| 33. | Target A-HLE | Hetero Fc chain 1 | QVQLVESGGGLVKPGGSLRLSCAASGFTFSDYYMTWIRQAPGKGLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGGGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLGGGGDKTHTCPPCPAPELLGGPS VFLFPPKPKDTLMISRTPEVTCVVVDVSHEDPEVKFNWYVDGVEVHN AKTKPCEEQYGSTYRCVSVLTVLHQDWLNGKEYKCKVSNKALPAPIE KTISKAKGQPREPQVYTLPPSRKEMTKNQVSLTCLVKGFYPSDIAVE WESNGQPENNYKTTPPVLKSDGSFFLYSKLTVDKSRWQQGNVFSCSV MHEALHNHYTQKSLSLSPGK |
| 34. | Target A-HLE | Hetero Fc chain 2 | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYDTTPPVLDSDGSFFLYS DLTVDKSRWQQGNVFSCSVMHEALHNHYTQKSLSLSPGK |
| 35. | Target A-HLE | hALB fusion | QVQLVESGGGLVKPGGSLRLSCAASGFTFSDYYMTWIRQAPGKGLEW LSYISSSGSTIYYADSVKGRFTISRDNAKNSLFLQMNSLRAEDTAVY YCARDRNSHFDYWGQGTLVTVSSGGGGSGGGGSGGGGSDIQMTQSPS SVSASVGDRVTITCRASQGINTWLAWYQQKPGKAPKLLIYGASGLQS GVPSRFSGSGSGTDFTLTISSLQPEDFATYYCQQAKSFPRTFGGGTK VEIKSGGGGSEVQLVESGGGLVQPGGSLKLSCAASGFTFNKYAMNWV RQAPGKGLEWVARIRSKYNNYATYYADSVKDRFTISRDDSKNTAYLQ MNNLKTEDTAVYYCVRHGNFGNSYISYWAYWGQGTLVTVSSGGGGSG GGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDE AEYYCVLWYSNRWVFGGGTKLTVLPGGDGSDAHKSEVAHRFKDLGEE NFKALVLIAFAQYLQQCPFEDHVKLVNEVTEFAKTCVADESAENCDK |

| SEQ ID NO: | Designation | Format/ Source | Sequence |
|---|---|---|---|
| | | | SLHTLFGDKLCTVATLRETYGEMADCCAKQEPERNECFLQHKDDNPN<br>LPRLVRPEVDVMCTAFHDNEETFLKKYLYEIARRHPYFYAPELLFFA<br>KRYKAAFTECCQAADKAACLLPKLDELRDEGKASSAKQRLKCASLQK<br>FGERAFKAWAVARLSQRFPKAEFAEVSKLVTDLTKVHTECCHGDLLE<br>CADDRADLAKYICENQDSISSKLKECCEKPLLEKSHCIAEVENDEMP<br>ADLPSLAADFVESKDVCKNYAEAKDVFLGMFLYEYARRHPDYSVVLL<br>LRLAKTYETTLEKCCAAADPHECYAKVFDEFKPLVEEPQNLIKQNCE<br>LFEQLGEYKFQNALLVRYTKKVPQVSTPTLVEVSRNLGKVGSKCCKH<br>PEAKRMPCAEDYLSVVLNQLCVLHEKTPVSDRVTKCCTESLVNRRPC<br>FSALEVDETYVPKEFNAETFTFHADICTLSEKERQIKKQTALVELVK<br>HKPKATKEQLKAVMDDFAAFVEKCCKADDKETCFAEEGKKLVAASQA<br>ALGLHHHHHH |
| 36. | Target B-HLEa | X-body chain 1 | EVQLVESGGGLVQPGGSLKLSCAASGFTFNKYAMNWVRQAPGKGLEW<br>VARIRSKYNNYATYYADSVKDRFTISRDDSKNTAYLQMNNLKTEDTA<br>VYYCVRHGNFGNSYISYWAYWGQGTLVTVSSGGGGSGGGGSSYELTQ<br>PPSVSVSPGQTASITCSGDRLGEKYTSWYQQRPGQSPLLVIYQDTKR<br>PSGIPERFSGSNSGNTATLTISGTQAMDEADYYCQAWESSTVVFGGG<br>TKLTVLASTKGPSVFPLAPSSKSTSGGTAALGCLVKDYFPEPVTVSW<br>NSGALTSGVHTFPAVLQSSGLYSLSSVVTVPSSSLGTQTYICNVNHK<br>PSNTKVDKKVEPKSCDKTHTCPPCPAPELLGGPSVFLFPPKPKDTLM<br>ISRTPEVTCVVVDVSHEDPEVKFNWYVDGVEVHNAKTKPCEEQYGST<br>YRCVSVLTVLHQDWLNGKEYKCKVSNKALPAPIEKTISKAKGQPREP<br>QVYTLPPSREEMTKNQVSLTCLVKGFYPSDIAVEWESNGQPENNYDT<br>TPPVLDSDGSFFLYSDLTVDKSRWQQGNVFSCSVMHEALHNHYTQKS<br>LSLSPGK |
| 37. | Target B-HLEb | X-body chain 2 | QVQLVESGGGVVQPGGSLRLSCAASGFTFSSYGMHWVRQAPGKGLEW<br>VAFIWYEGSNKYYAESVKDRFTISRDNSKNTLYLQMNSLRAEDTAVY<br>YCARRAGIIGTIGYYYGMDVWGQGTTVTVSSGGGGSGGGGSQTVVTQ<br>EPSLTVSPGGTVTLTCGSSTGAVTSGNYPNWVQQKPGQAPRGLIGGT<br>KFLAPGTPARFSGSLLGGKAALTLSGVQPEDEAEYYCVLWYSNRWVF<br>GGGTKLTVLGQPKAAPSVTLFPPSSEELQANKATLVCLISDFYPGAV<br>TVAWKADSSPVKAGVETTTPSKQSNNKYAASSYLSLTPEQWKSHRSY<br>SCQVTHEGSTVEKTVAPTECSDKTHTCPPCPAPELLGGPSVFLFPPK<br>PKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAK<br>GQPREPQVYTLPPSRKEMTKNQVSLTCLVKGFYPSDIAVEWESNGQP<br>ENNYKTTPPVLKSDGSFFLYSKLTVDKSRWQQGNVFSCSVMHEALHN<br>HYTQKSLSLSPGK |
| 38. | Target B-HLE | Hetero Fc chain 1 | QVQLVESGGGVVQPGGSLRLSCAASGFTFSSYGMHWVRQAPGKGLEW<br>VAFIWYEGSNKYYAESVKDRFTISRDNSKNTLYLQMNSLRAEDTAVY<br>YCARRAGIIGTIGYYYGMDVWGQGTTVTVSSGGGGSGGGGSGGGGSS<br>YELTQPPSVSVSPGQTASITCSGDRLGEKYTSWYQQRPGQSPLLVIY<br>QDTKRPSGIPERFSGSNSGNTATLTISGTQAMDEADYYCQAWESSTV<br>VFGGGTKLTVLSGGGGSEVQLVESGGGLVQPGGSLKLSCAASGFTFN<br>KYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVS<br>SGGGGSGGGGSGGGGSQTVVTQEPSLTVSPGGTVTLTCGSSTGAVTS<br>GNYPNWVQQKPGQAPRGLIGGTKFLAPGTPARFSGSLLGGKAALTLS<br>GVQPEDEAEYYCVLWYSNRWVFGGGTKLTVLGGGGDKTHTCPPCPAP<br>ELLGGPSVFLFPPKPKDTLMISRTPEVTCVVVDVSHEDPEVKFNWYV<br>DGVEVHNAKTKPCEEQYGSTYRCVSVLTVLHQDWLNGKEYKCKVSNK<br>ALPAPIEKTISKAKGQPREPQVYTLPPSRKEMTKNQVSLTCLVKGFY<br>PSDIAVEWESNGQPENNYKTTPPVLKSDGSFFLYSKLTVDKSRWQQG<br>NVFSCSVMHEALHNHYTQKSLSLSPGK |
| 39. | Target B-HLE | Hetero Fc chain 2 | DKTHTCPPCPAPELLGGPSVFLFPPKPKDTLMISRTPEVTCVVVDVS<br>HEDPEVKFNWYVDGVEVHNAKTKPCEEQYGSTYRCVSVLTVLHQDWL<br>NGKEYKCKVSNKALPAPIEKTISKAKGQPREPQVYTLPPSREEMTKN<br>QVSLTCLVKGFYPSDIAVEWESNGQPENNYDTTPPVLDSDGSFFLYS<br>DLTVDKSRWQQGNVFSCSVMHEALHNHYTQKSLSLSPGK |
| 40. | Target C-HLE | Hetero Fc chain 1 | QVQLVQSGAEVKKPGESVKVSCKASGYTFTNYGMNWVKQAPGQCLEW<br>MGWINTYTGEPTYADKFQGRVTMTTDTSTSTAYMEIRNLGGDDTAVY<br>YCARWSWSDGYYVYFDYWGQGTSVTVSSGGGGSGGGGSGGGGSDIVM<br>TQSPDSLTVSLGERTTINCKSSQSVLDSSTNKNSLAWYQQKPGQPPK<br>LLLSWASTRESGIPDRFSGSGSGTDFTLTIDSPQPEDSATYYCQQSA<br>HFPITFGCGTRLEIKSGGGGSEVQLVESGGGLVQPGGSLKLSCAASG<br>FTFNKYAMNWVRQAPGKGLEWVARIRSKYNNYATYYADSVKDRFTIS<br>RDDSKNTAYLQMNNLKTEDTAVYYCVRHGNFGNSYISYWAYWGQGTL<br>VTVSSGGGGSGGGGSGGGGSQTVVTQEPSLTVSPGGTVTLTCGSSTG<br>AVTSGNYPNWVQQKPGQAPRGLIGGTKFLAPGTPARFSGSLLGGKAA<br>LTLSGVQPEDEAEYYCVLWYSNRWVFGGGTKLTVLGGGGDKTHTCPP |

TABLE 38-continued

Sequence Table

| SEQ ID NO: | Designation | Format/Source | Sequence |
|---|---|---|---|
| | | | CPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCK VSNKALPAPIEKTISKAKGQPREPQVYTLPPSRKEMTKNQVSLTCLV KGFYPSDIAVEWESNGQPENNYKTTPPVLKSDGSFFLYSKLTVDKSR WQQGNVFSCSVMHEALHNHYTQKSLSLSPGK |
| 41. | Target C-HLE | Hetero Fc chain 2 | DKTHTCPPCPAPELLGGPSVFLFPPKPKDTLMISRTPEVTCVVVDVS HEDPEVKFNWYVDGVEVHNAKTKPCEEQYGSTYRCVSVLTVLHQDWL NGKEYKCKVSNKALPAPIEKTISKAKGQPREPQVYTLPPSREEMTKN QVSLTCLVKGFYPSDIAVEWESNGQPENNYDTTPPVLDSDGSFFLYS DLTVDKSRWQQGNVFSCSVMHEALHNHYTQKSLSLSPGK |
| 42. | PM_1xCD3-scFc | VH CDR1 | DYYMN |
| 43. | PM_1xCD3-scFc | VH CDR2 | IISDGGYYTYYSDIIKG |
| 44. | PM_1xCD3-scFc | VH CDR3 | GFPLLRHGAMDY |
| 45. | PM_1xCD3-scFc | VL CDR1 | KASQNVDTNVA |
| 46. | PM_1xCD3-scFc | VL CDR2 | SASYRYS |
| 47. | PM_1xCD3-scFc | VL CDR3 | QQYDSYPYT |
| 48. | PM_1xCD3-scFc | VH | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSS |
| 49. | PM_1xCD3-scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDSY PYTFGGGTKLEIK |
| 50. | PM_1xCD3-scFc | scFv | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIK |
| 51. | PM_1xCD3-scFc | bispecific molecule | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 52. | PM_1xCD3-scFc | bispecific HLE molecule | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT |

TABLE 38-continued

Sequence Table

| SEQ ID NO: | Designation | Format/ Source | Sequence |
|---|---|---|---|
| | | | VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 53. | PM_1xCD3-<br>scFc_delGK | bispecific<br>HLE<br>molecule | QVQLVESGGGLVKPGESLRLSCAASGFTFSDYYMNWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDSYPYTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 54. | PM_1_CCxCD3-<br>scFc | VH | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSS |
| 55. | PM_1_CCxCD3-<br>scFc | VL | DIQMTQSPSSLSASVGDRVTITCKASQNVDTNVAWYQQKPGQAPKSL<br>IYSASYRYSDVPSRFSGSASGTDFTLTISSLQSEDFATYYCQQYDSY<br>PYTFGCGTKLEIK |
| 56. | PM_1_CCxCD3-<br>scFc | scFv | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDSYPYTFG<br>CGTKLEIK |
| 57. | PM_1_CCxCD3-<br>scFc | bispecific<br>molecule | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 58. | PM_1_CCxCD3-<br>scFc | bispecific<br>HLE<br>molecule | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |

TABLE 38-continued

Sequence Table

| SEQ ID NO: | Designation | Format/ Source | Sequence |
|---|---|---|---|
| 59. | PM_1_CCxCD3-scFc_delGK | bispecific HLE molecule | QVQLVESGGGLVKPGESLRLSCAASGFTFSDYYMNWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 60. | PM_2xCD3-scFc | VH CDR1 | DYYMY |
| 61. | PM_2xCD3-scFc | VH CDR2 | IISDAGGLTYYSDIIKG |
| 62. | PM_2xCD3-scFc | VH CDR3 | GFPLLRHGAMDY |
| 63. | PM_2xCD3-scFc | VL CDR1 | KASQNVDTNVA |
| 64. | PM_2xCD3-ScFc | VL CDR2 | SASYRYS |
| 65. | PM_2xCD3-ScFc | VL CDR3 | QQYDSYPYT |
| 66. | PM_2xCD3-scFc | VH | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSS |
| 67. | PM_2xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGGGTKLEIK |
| 68. | PM_2xCD3-scFc | scFv | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIK |
| 69. | PM_2xCD3-scFc | bispecific molecule | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 70. | PM_2xCD3-scFc | bispecific HLE molecule | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 38-continued

Sequence Table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 71. | PM_2xCD3- scFcdeIGK | bispecific HLE molecule | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 72. | PM_2_CCxCD3- scFc | VH | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSS |
| 73. | PM_2_CCxCD3- scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGCGTKLEIK |
| 74. | PM_2_CCxCD3- scFc | scFv | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIK |
| 75. | PM_2_CCxCD3- scFc | bispecific molecule | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 76. | PM_2_CCxCD3- scFc | bispecific HLE molecule | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP |

TABLE 38-continued

Sequence Table

| SEQ ID NO: | Designation | Format/ Source | Sequence |
|---|---|---|---|
| | | | APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 77. | PM_2_CCxCD3-scFc_delGK | bispecific HLE molecule | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 78. | PM_3xCD3-ScFc | VH CDR1 | DYYMY |
| 79. | PM_3xCD3-scFc | VH CDR2 | IISDAGGLTYYSDIIKG |
| 80. | PM_3xCD3-scFc | VH CDR3 | GFPLLRHGAMDY |
| 81. | PM_3xCD3-scFc | VL CDR1 | KASQNVDTNVA |
| 82. | PM_3xCD3-ScFc | VL CDR2 | SASYRYS |
| 83. | PM_3xCD3-ScFc | VL CDR3 | QQYDDLRPT |
| 84. | PM_3xCD3-scFc | VH | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSS |
| 85. | PM_3xCD3-scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDDL RPTFGGGTKLEIK |
| 86. | PM_3xCD3-scFc | scFv | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIK |
| 87. | PM_3xCD3-scFc | bispecific molecule | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

US 10,781,264 B2

113                                                                                     114

TABLE 38-continued

Sequence Table

| SEQ ID NO: | Designation | Format/Source | Sequence |
|---|---|---|---|
| 88. | PM_3xCD3-scFc | bispecific HLE molecule | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 89. | PM_3xCD3-scFc_delGK | bispecific HLE molecule | QVQLVESGGGLVKPGESLRLSCAASGFTFSDYYMYWVRQAPGKGLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 90. | PM_3_CCxCD3-scFc | VH | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSS |
| 91. | PM_3_CCxCD3-scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDDL RPTFGCGTKLEIK |
| 92. | PM_3_CCxCD3-scFc | scFv | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIK |
| 93. | PM_3_CCxCD3-scFc | bispecific molecule | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 94. | PM_3_CCxCD3-scFc | bispecific HLE molecule | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT |

TABLE 38-continued

Sequence Table

| SEQ ID NO: | Designation | Format/ Source | Sequence |
|---|---|---|---|
| | | | QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 95. | PM_3_CCxCD3-scFc_delGK | bispecific HLE molecule | QVQLVESGGGLVKPGESLRLSCAASGFTFSDYYMYWVRQAPGKCLEW VAIISDAGGLTYYSDIIKGRFTISRDNAKNSLYLQINSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 96. | PM_4xCD3-scFc | VH CDR1 | DYYMY |
| 97. | PM_4xCD3-scFc | VH CDR2 | IISDHYSHTYYSDIIKD |
| 98. | PM_4xCD3-scFc | VH CDR3 | GFPLLRHGAMDY |
| 99. | PM_4xCD3-scFc | VL CDR1 | KASQNVDTNVA |
| 100. | PM_4xCD3-scFc | VL CDR2 | SASYRYS |
| 101. | PM_4xCD3-scFc | VL CDR3 | QQYDSYPYT |
| 102. | PM_4xCD3-scFc | VH | QVQLVESGGGLVKPGESLRLSCAASGFTFSDYYMYWVRQAPGKGLEW VAIISDHYSHTYYSDIIKDRFTISRDNAKNSLYLQMNSLKAEDTAVY YCARGFPLLRHGAMDYWGQGTLVTVSS |
| 103. | PM_4xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGGGTKLEIK |
| 104. | PM_4xCD3-scFc | scFv | QVQLVESGGGLVKPGESLRLSCAASGFTFSDYYMYWVRQAPGKGLEW VAIISDHYSHTYYSDIIKDRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIK |

TABLE 38-continued

Sequence Table

| SEQ ID NO: | Designation | Format/ Source | Sequence |
|---|---|---|---|
| 105. | PM_4xCD3-scFc | bispecific molecule | QVQLVESGGGLVKPGESLRLSCAASGFTFSDYYMYWVRQAPGKGLEW VAIISDHYSHTYYSDIIKDRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 106. | PM_4xCD3-scFc | bispecific HLE molecule | QVQLVESGGGLVKPGESLRLSCAASGFTFSDYYMYWVRQAPGKGLEW VAIISDHYSHTYYSDIIKDRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 107. | PM_4xCD3-scFc_delGK | bispecific HLE molecule | QVQLVESGGGLVKPGESLRLSCAASGFTFSDYYMYWVRQAPGKGLEW VAIISDHYSHTYYSDIIKDRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 108. | PM_4_CCxCD3-scFc | VH | QVQLVESGGGLVKPGESLRLSCAASGFTFSDYYMYWVRQAPGKCLEW VAIISDHYSHTYYSDIIKDRFTISRDNAKNSLYLQMNSLKAEDTAVY YCARGFPLLRHGAMDYWGQGTLVTVSS |
| 109. | PM_4_CCxCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGCGTKLEIK |
| 110. | PM_4_CCxCD3-scFc | scFv | QVQLVESGGGLVKPGESLRLSCAASGFTFSDYYMYWVRQAPGKCLEW VAIISDHYSHTYYSDIIKDRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIK |
| 111. | PM_4_CCxCD3-scFc | bispecific molecule | QVQLVESGGGLVKPGESLRLSCAASGFTFSDYYMYWVRQAPGKCLEW VAIISDHYSHTYYSDIIKDRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS |

119
120

TABLE 38-continued

Sequence Table

| SEQ ID NO: | Designation | Format/ Source | Sequence |
|---|---|---|---|
| | | | YRYSDVPSRFSGSASGTDFTLTISSVQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 112. | PM_4_CCxCD3-<br>scFc | bispecific<br>HLE<br>molecule | QVQLVESGGGLVKPGESLRLSCAASGFTFSDYYMYWVRQAPGKCLEW<br>VAIISDHYSHTYYSDIIKDRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 113. | PM_4_CCxCD3-<br>scFc_delGK | bispecific<br>HLE<br>molecule | QVQLVESGGGLVKPGESLRLSCAASGFTFSDYYMYWVRQAPGKCLEW<br>VAIISDHYSHTYYSDIIKDRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 114. | PM_5xCD3-<br>scFc | VH CDR1 | DYYMY |
| 115. | PM_5xCD3-<br>scFc | VH CDR2 | IISDKRHHTYYSDIIKG |
| 116. | PM_5xCD3-<br>scFc | VH CDR3 | GFPLLRHGAMDY |
| 117. | PM_5xCD3-<br>scFc | VL CDR1 | KASQNVDTNVA |
| 118. | PM_5xCD3-<br>scFc | VL CDR2 | SASYRYS |
| 119. | PM_5xCD3-<br>scFc | VL CDR3 | QQYDSYPYT |
| 120. | PM_5xCD3-<br>scFc | VH | QVQLVESGGGLVKPGESLRLSCAASGFTFSDYYMYWVRQAPGKGLEW<br>VAIISDKRHHTYYSDIIKGRFTISRDNAKNSLYLQMNSLKAEDTAVY<br>YCARGFPLLRHGAMDYWGQGTLVTVSS |

TABLE 38-continued

Sequence Table

| SEQ ID NO: | Designation | Format/Source | Sequence |
|---|---|---|---|
| 121. | PM_5xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGGGTKLEIK |
| 122. | PM_5xCD3-scFc | scFv | QVQLVESGGGLVKPGESLRLSCAASGFTFSDYYMYWVRQAPGKGLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIK |
| 123. | PM_5xCD3-scFc | bispecific molecule | QVQLVESGGGLVKPGESLRLSCAASGFTFSDYYMYWVRQAPGKGLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 124. | PM_5xCD3-scFc | bispecific HLE molecule | QVQLVESGGGLVKPGESLRLSCAASGFTFSDYYMYWVRQAPGKGLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 125. | PM_5xCD3-scFcdeIGK | bispecific HLE molecule | QVQLVESGGGLVKPGESLRLSCAASGFTFSDYYMYWVRQAPGKGLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 126. | PM_5_CCxCD3-scFc | VH | QVQLVESGGGLVKPGESLRLSCAASGFTFSDYYMYWVRQAPGKCLEW AMDYWGQGTLVTVSS |
| 127. | PM_5_CCxCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGCGTKLEIK |

TABLE 38-continued

Sequence Table

| SEQ ID NO: | Designation | Format/ Source | Sequence |
|---|---|---|---|
| 128. | PM_5_CCxCD3-scFc | scFv | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIK |
| 129. | PM_5_CCxCD3-scFc | bispecific molecule | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 130. | PM_5_CCxCD3-scFc | bispecific HLE molecule | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 131. | PM_5_CCxCD3-scFc_delGK | bispecific HLE molecule | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 132. | PM_6xCD3-scFc | VH CDR1 | DYYMY |
| 133. | PM_6xCD3-scFc | VH CDR2 | IISDKRHHTYYSDIIKG |
| 134. | PM_6xCD3-scFc | VH CDR3 | GFPLLRHGAMDY |
| 135. | PM_6xCD3-scFc | VL CDR1 | KASQNVDTNVA |

TABLE 38-continued

Sequence Table

| SEQ ID NO: | Designation | Format/ Source | Sequence |
|---|---|---|---|
| 136. | PM_6xCD3-scFc | VL CDR2 | SASYRYS |
| 137. | PM_6xCD3-scFc | VL CDR3 | QQYDDLRPT |
| 138. | PM_6xCD3-scFc | VH | QVQLVESGGGLVKPGESLRLSCAASGFTFSDYYMYWVRQAPGKGLEW<br>VAIISDKRHHTYYSDIIKGRFTISRDNAKNSLYLQMNSLKAEDTAVY<br>YCARGFPLLRHGAMDYWGQGTLVTVSS |
| 139. | PM_6xCD3-scFc | VL | DIQMTQSPSSLSASVGDRVTITCKASQNVDTNVAWYQQKPGQAPKSL<br>IYSASYRYSDVPSRFSGSASGTDFTLTISSLQSEDFATYYCQQYDDL<br>RPTFGGGTKLEIK |
| 140. | PM_6xCD3-scFc | scFv | QVQLVESGGGLVKPGESLRLSCAASGFTFSDYYMYWVRQAPGKGLEW<br>VAIISDKRHHTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDDLRPTFG<br>GGTKLEIK |
| 141. | PM_6xCD3-scFc | bispecific molecule | QVQLVESGGGLVKPGESLRLSCAASGFTFSDYYMYWVRQAPGKGLEW<br>VAIISDKRHHTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDDLRPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 142. | PM_6xCD3-scFc | bispecific HLE molecule | QVQLVESGGGLVKPGESLRLSCAASGFTFSDYYMYWVRQAPGKGLEW<br>VAIISDKRHHTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDDLRPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 143. | PM_6xCD3-scFcdeIGK | bispecific HLE molecule | QVQLVESGGGLVKPGESLRLSCAASGFTFSDYYMYWVRQAPGKGLEW<br>VAIISDKRHHTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDDLRPTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL |

TABLE 38-continued

Sequence Table

| SEQ ID NO: | Designation | Format/ Source | Sequence |
|---|---|---|---|
| | | | HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 144. | PM_6_CCxCD3-scFc | VH | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSS |
| 145. | PM_6_CCxCD3-scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDDL RPTFGCGTKLEIK |
| 146. | PM_6_CCxCD3-scFc | scFv | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIK |
| 147. | PM_6_CCxCD3-scFc | bispecific molecule | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 148. | PM_6_CCxCD3-scFc | bispecific HLE molecule | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 149. | PM_6_CCxCD3-scFc_delGK | bispecific HLE molecule | QVQLVESGGGLVKPGESLRLSCAASGFTFSDYYMYWVRQAPGKCLEW VAIISDKRHHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |

TABLE 38-continued

Sequence Table

| SEQ ID NO: | Designation | Format/Source | Sequence |
|---|---|---|---|
| 150. | PM_7xCD3-scFc | VH CDR1 | DYYMY |
| 151. | PM_7xCD3-scFc | VH CDR2 | IISDGGYYTYYSDIIKG |
| 152. | PM_7xCD3-scFc | VH CDR3 | GFPLLRHGAMDY |
| 153. | PM_7xCD3-scFc | VL CDR1 | KASQNVDTNVA |
| 154. | PM_7xCD3-scFc | VL CDR2 | SASYRYS |
| 155. | PM_7xCD3-scFc | VL CDR3 | QQYDQQLIT |
| 156. | PM_7xCD3-scFc | VH | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSS |
| 157. | PM_7xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDQQ LITFGGGTKLEIK |
| 158. | PM_7xCD3-scFc | scFv | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIK |
| 159. | PM_7xCD3-scFc | bispecific molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 160. | PM_7xCD3-scFc | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 161. | PM_7xCD3-scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 38-continued

Sequence Table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 162. | PM_7_CCxCD 3-scFc | VH | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSS |
| 163. | PM_7_CCxCD3- scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDQQ LITFGCGTKLEIK |
| 164. | PM_7_CCxCD 3-scFc | scFv | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIK |
| 165. | PM_7_CCxCD3- scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 166. | PM_7_CCxCD3- scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 167. | PM_7_CCxCD3- scFc_delGK | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV |

TABLE 38-continued

Sequence Table

| SEQ ID NO: | Designation | Format/Source | Sequence |
|---|---|---|---|
| | | | EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 168. | PM_8xCD3-scFc | VH CDR1 | DYYMY |
| 169. | PM_8xCD3-scFc | VH CDR2 | IISDGGYYTYYSDIIKG |
| 170. | PM_8xCD3-scFc | VH CDR3 | GFPLLRHGAMDY |
| 171. | PM_8xCD3-scFc | VL CDR1 | KASQNVDTNVA |
| 172. | PM_8xCD3-scFc | VL CDR2 | SASYRYS |
| 173. | PM_8xCD3-scFc | VL CDR3 | QQYDQVRLT |
| 174. | PM_8xCD3-scFc | VH | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSS |
| 175. | PM_8xCD3-scFc | VL | DIQMTQSPSSLSASVGDRVTITCKASQNVDTNVAWYQQKPGQAPKSL<br>IYSASYRYSDVPSRFSGSASGTDFTLTISSVQSEDFATYYCQQYDQV<br>RLTFGGGTKLEIK |
| 176. | PM_8xCD3-scFc | scFv | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDQVRLTFG<br>GGTKLEIK |
| 177. | PM_8xCD3-scFc | bispecific molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDQVRLTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 178. | PM_8xCD3-scFc | bispecific HLE molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDQVRLTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT |

TABLE 38-continued

Sequence Table

| SEQ ID NO: | Designation | Format/ Source | Sequence |
|---|---|---|---|
| | | | VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 179. | PM_8xCD3-scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY QGTLVTVSYCARGFPLLRHGAMDYWGSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQVRLTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 180. | PM_8_CCxCD3-scFc | VH | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSS |
| 181. | PM_8_CCxCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDQV RLTFGCGTKLEIK |
| 182. | PM_8_CCxCD3-scFc | scFv | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQVRLTFG CGTKLEIK |
| 183. | PM_8_CCxCD3-scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQVRLTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 184. | PM_8_CCxCD3-scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQVRLTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

US 10,781,264 B2

137                                                                 138

TABLE 38-continued

Sequence Table

| SEQ ID NO: | Designation | Format/ Source | Sequence |
|---|---|---|---|
| 185. | PM_8_CCxCD3-scFc_delGK | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQVRLTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 186. | PM_9xCD3-scFc | VH CDR1 | DYYMN |
| 187. | PM_9xCD3-scFc | VH CDR2 | IISDGGYYTYYSDIIKG |
| 188. | PM_9xCD3-scFc | VH CDR3 | GFPLLRHGAMDY |
| 189. | PM_9xCD3-scFc | VL CDR1 | KASQNVDTNVA |
| 190. | PM_9xCD3-scFc | VL CDR2 | SASYRYS |
| 191. | PM_9xCD3-scFc | VL CDR3 | QQYDDLRPT |
| 192. | PM_9xCD3-scFc | VH | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSS |
| 193. | PM_9xCD3-scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDDL RPTFGGGTKLEIK |
| 194. | PM_9xCD3-scFc | scFv | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIK |
| 195. | PM_9xCD3-scFc | bispecific molecule | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 196. | PM_9xCD3-scFc | bispecific HLE molecule | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 38-continued

Sequence Table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 197. | PM_9xCD3- scFc_delGK | bispecific HLE molecule | QVQLVESGGGLVKPGESLRLSCAASGFTFSDYYMNWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 198. | PM_9_CCxCD3- scFc | VH | QVQLVESGGGLVKPGESLRLSCAASGFTFSDYYMNWVRQAPGKCLEW VAIISDGGYYTYYSDIIKGRFTISRDNAKNSLYLQMNSLKAEDTAVY YCARGFPLLRHGAMDYWGQGTLVTVSS |
| 199. | PM_9_CCxCD3- scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDDL RPTFGCGTKLEIK |
| 200. | PM_9_CCxCD3- scFc | scFv | QVQLVESGGGLVKPGESLRLSCAASGFTFSDYYMNWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIK |
| 201. | PM_9_CCxCD3- scFc | bispecific molecule | QVQLVESGGGLVKPGESLRLSCAASGFTFSDYYMNWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 202. | PM_9_CCxCD3- scFc | bispecific HLE molecule | QVQLVESGGGLVKPGESLRLSCAASGFTFSDYYMNWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV |

TABLE 38-continued

Sequence Table

| SEQ ID NO: | Designation | Format/ Source | Sequence |
|---|---|---|---|
| | | | EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 203. | PM_9_CCxCD3-scFc_delGK | bispecific HLE molecule | QVQLVESGGGLVKPGESLRLSCAASGFTFSDYYMNWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDDLRPTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 204. | PM_10xCD3-scFc | VH CDR1 | DYYMY |
| 205. | PM_10xCD3-scFc | VH CDR2 | IISDHHHWTYYSDIIKG |
| 206. | PM_10xCD3-scFc | VH CDR3 | GFPLLRHGAMDY |
| 207. | PM_10xCD3-scFc | VL CDR1 | KASQNVDTNVA |
| 208. | PM_10xCD3-scFc | VL CDR2 | SASYRYS |
| 209. | PM_10xCD3-scFc | VL CDR3 | QQYDSYPYT |
| 210. | PM_10xCD3-scFc | VH | QVQLVESGGGLVKPGESLRLSCAASGFTFSDYYMYWVRQAPGKGLEW VAIISDHHHWTYYSDIIKGRFTISRDNAKNSLYLQMNSLKAEDTAVY YCARGFPLLRHGAMDYWGQGTLVTVSS |
| 211. | PM_10xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGGGTKLEIK |
| 212. | PM_10xCD3-scFc | scFv | QVQLVESGGGLVKPGESLRLSCAASGFTFSDYYMYWVRQAPGKGLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIK |
| 213. | PM_10xCD3-scFc | bispecific molecule | QVQLVESGGGLVKPGESLRLSCAASGFTFSDYYMYWVRQAPGKGLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 38-continued

Sequence Table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 214. | PM_10xCD3-scFc | bispecific HLE molecule | QVQLVESGGGLVKPGESLRLSCAASGFTFSDYYMYWVRQAPGKGLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 215. | PM_10xCD3-scFc_delGK | bispecific HLE molecule | QVQLVESGGGLVKPGESLRLSCAASGFTFSDYYMYWVRQAPGKGLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 216. | PM_10_CCxCD3-scFc | VH | QVQLVESGGGLVKPGESLRLSCAASGFTFSDYYMYWVRQAPGKCLEW VAIISDHHHWTYYSDIIKGRFTISRDNAKNSLYLQMNSLKAEDTAVY YCARGFPLLRHGAMDYWGQGTLVTVSS |
| 217. | PM_10_CCxCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGCGTKLEIK |
| 218. | PM_10_CCxCD3-scFc | scFv | QVQLVESGGGLVKPGESLRLSCAASGFTFSDYYMYWVRQAPGKCLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIK |
| 219. | PM_10_CCxCD3-scFc | bispecific molecule | QVQLVESGGGLVKPGESLRLSCAASGFTFSDYYMYWVRQAPGKCLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 38-continued

Sequence Table

| SEQ ID NO: | Designation | Format/Source | Sequence |
|---|---|---|---|
| 220. | PM_10_CCxCD3-scFc | bispecific HLE molecule | QVQLVESGGGLVKPGESLRLSCAASGFTFSDYYMYWVRQAPGKCLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 221. | PM_10_CCxCD3-scFc_delGK | bispecific HLE molecule | QVQLVESGGGLVKPGESLRLSCAASGFTFSDYYMYWVRQAPGKCLEW VAIISDHHHWTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 222. | PM_11xCD3-ScFc | VH CDR1 | DYYMY |
| 223. | PM_11xCD3-scFc | VH CDR2 | IISDGGYYTYYSDIIKG |
| 224. | PM_11xCD3-scFc | VH CDR3 | GFPLLRHGAMDY |
| 225. | PM_11xCD3-scFc | VL CDR1 | KASQNVDTNVA |
| 226. | PM_11xCD3-scFc | VL CDR2 | SASYRYS |
| 227. | PM_11xCD3-scFc | VL CDR3 | QQYDRQPLT |
| 228. | PM_11xCD3-scFc | VH | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSS |
| 229. | PM_11xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDRQ PLTFGGGTKLEIK |
| 230. | PM_11xCD3-scFc | scFv | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT |

TABLE 38-continued

Sequence Table

| SEQ ID NO: | Designation | Format/Source | Sequence |
|---|---|---|---|
| | | | QSPSSLSASVGDRVTITCKASQNVDTNVAWYQQKPGQAPKSLIYSAS YRYSDVPSRFSGSASGTDFTLTISSVQSEDFATYYCQQYDRQPLTFG GGTKLEIK |
| 231. | PM_11xCD3-scFc | bispecific molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 232. | PM_11xCD3-scFc | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 233. | PM_11xCD3-scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 234. | PM_11_CCxCD3-scFc | VH | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSS |
| 235. | PM_11_CCxCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDRQ PLTFGCGTKLEIK |
| 236. | PM_11_CCxCD3-scFc | scFv | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG CGTKLEIK |

TABLE 38-continued

Sequence Table

| SEQ ID NO: | Designation | Format/ Source | Sequence |
|---|---|---|---|
| 237. | PM_11_CCxCD3-scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 238. | PM_11_CCxCD3-scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 239. | PM_11_CCxCD3-scFc_delGK | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDRQPLTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 240. | PM_12xCD3-scFc | VH CDR1 | DYYMN |
| 241. | PM_12xCD3-scFc | VH CDR2 | IISDGGYYTYYSDIIKG |
| 242. | PM_12xCD3-scFc | VH CDR3 | GFPLLRHGAMDY |
| 243. | PM_12xCD3-scFc | VL CDR1 | KASQNVDTNVA |
| 244. | PM_12xCD3-scFc | VL CDR2 | SASYRYS |
| 245. | PM_12xCD3-scFc | VL CDR3 | QQYDLLLLT |

TABLE 38-continued

Sequence Table

| SEQ ID NO: | Designation | Format/Source | Sequence |
|---|---|---|---|
| 246. | PM_12xCD3-scFc | VH | QVQLVESGGGLVKPGESLRLSCAASGFTFSDYYMNWVRQAPGKGLEW<br>VAIISDGGYYTYYSDIIKGRFTISRDNAKNSLYLQMNSLKAEDTAVY<br>YCARGFPLLRHGAMDYWGQGTLVTVSS |
| 247. | PM_12xCD3-scFc | VL | DIQMTQSPSSLSASVGDRVTITCKASQNVDTNVAWYQQKPGQAPKSL<br>IYSASYRYSDVPSRFSGSASGTDFTLTISSLQSEDFATYYCQQYDLL<br>LLTFGGGTKLEIK |
| 248. | PM_12xCD3-scFc | scFv | QVQLVESGGGLVKPGESLRLSCAASGFTFSDYYMNWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>GGTKLEIK |
| 249. | PM_12xCD3-scFc | bispecific molecule | QVQLVESGGGLVKPGESLRLSCAASGFTFSDYYMNWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 250. | PM_12xCD3-scFc | bispecific HLE molecule | QVQLVESGGGLVKPGESLRLSCAASGFTFSDYYMNWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 251. | PM_12xCD3-scFc_delGK | bispecific HLE molecule | QVQLVESGGGLVKPGESLRLSCAASGFTFSDYYMNWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 252. | PM_12_CCxCD3-scFc | VH | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSS |

TABLE 38-continued

Sequence Table

| SEQ ID NO: | Designation | Format/Source | Sequence |
|---|---|---|---|
| 253. | PM_12_CCxCD3-scFc | VL | DIQMTQSPSSLSASVGDRVTITCKASQNVDTNVAWYQQKPGQAPKSL<br>IYSASYRYSDVPSRFSGSASGTDFTLTISSLQSEDFATYYCQQYDLL<br>LLTFGCGTKLEIK |
| 254. | PM_12_CCxCD3-scFc | scFv | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>CGTKLEIK |
| 255. | PM_12_CCxCD3-scFc | bispecific molecule | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 256. | PM_12_CCxCD3-scFc | bispecific HLE molecule | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 257. | PM_12_CCxCD3-scFc_delGK | bispecific HLE molecule | QVQLVESGGGLVKPGESLRLSCAASGFTFSDYYMNWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSLQSEDFATYYCQQYDLLLLTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 258. | PM_13xCD3-scFc | VH CDR1 | DYYMY |
| 259. | PM_13xCD3-scFc | VH CDR2 | IISDSTLHTYYSDIIKG |
| 260. | PM_13xCD3-scFc | VH CDR3 | GFPLLRHGAMDY |

TABLE 38-continued

Sequence Table

| SEQ ID NO: | Designation | Format/Source | Sequence |
|---|---|---|---|
| 261. | PM_13xCD3-scFc | VL CDR1 | KASQNVDTNVA |
| 262. | PM_13xCD3-scFc | VL CDR2 | SASYRYS |
| 263. | PM_13xCD3-scFc | VL CDR3 | QQYDSYPYT |
| 264. | PM_13xCD3-scFc | VH | QVQLVESGGGLVKPGESLRLSCAASGFTFSDYYMYWVRQAPGKGLEW VAIISDSTLHTYYSDIIKGRFTISRDNAKNSLYLQMNSLKAEDTAVY YCARGFPLLRHGAMDYWGQGTLVTVSS |
| 265. | PM_13xCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGGGTKLEIK |
| 266. | PM_13xCD3-scFc | scFv | QVQLVESGGGLVKPGESLRLSCAASGFTFSDYYMYWVRQAPGKGLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIK |
| 267. | PM_13xCD3-scFc | bispecific molecule | QVQLVESGGGLVKPGESLRLSCAASGFTFSDYYMYWVRQAPGKGLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 268. | PM_13xCD3-scFc | bispecific HLE molecule | QVQLVESGGGLVKPGESLRLSCAASGFTFSDYYMYWVRQAPGKGLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 269. | PM_13xCD3-scFc_delGK | bispecific HLE molecule | QVQLVESGGGLVKPGESLRLSCAASGFTFSDYYMYWVRQAPGKGLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV |

TABLE 38-continued

Sequence Table

| SEQ ID NO: | Designation | Format/Source | Sequence |
|---|---|---|---|
| | | | VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 270. | PM_13_CCxCD3-scFc | VH | QVQLVESGGGLVKPGESLRLSCAASGFTFSDYYMYWVRQAPGKCLEW VAIISDSTLHTYYSDIIKGRFTISRDNAKNSLYLQMNSLKAEDTAVY YCARGFPLLRHGAMDYWGQGTLVTVSS |
| 271. | PM_13_CCxCD3-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGCGTKLEIK |
| 272. | PM_13_CCxCD3-scFc | scFv | QVQLVESGGGLVKPGESLRLSCAASGFTFSDYYMYWVRQAPGKCLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIK |
| 273. | PM_13_CCxCD3-scFc | bispecific molecule | QVQLVESGGGLVKPGESLRLSCAASSDYYMYWVRQAPGFTFGKCLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 274. | PM_13_CCxCD3-scFc | bispecific HLE molecule | QVQLVESGGGLVKPGESLRLSCAASGFTFSDYYMYWVRQAPGKCLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 275. | PM_13_CCxCD3-scFc_delGK | bispecific HLE molecule | QVQLVESGGGLVKPGESLRLSCAASGFTFSDYYMYWVRQAPGKCLEW VAIISDSTLHTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |

TABLE 38-continued

Sequence Table

| SEQ ID NO: | Designation | Format/Source | Sequence |
|---|---|---|---|
| 276. | PM_14xCD3-scFc | VH CDR1 | DYYMY |
| 277. | PM_14xCD3-scFc | VH CDR2 | IISDGGYYTYYSDIIKG |
| 278. | PM_14xCD3-scFc | VH CDR3 | GFPLLRHGAMDY |
| 279. | PM_14xCD3-scFc | VL CDR1 | KASQNVDTNVA |
| 280. | PM_14xCD3-scFc | VL CDR2 | SASYRYS |
| 281. | PM_14xCD3-scFc | VL CDR3 | QQYDAPMGT |
| 282. | PM_14xCD3-scFc | VH | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSS |
| 283. | PM_14xCD3-scFc | VL | DIQMTQSPSSLSASVGDRVTITCKASQNVDTNVAWYQQKPGQAPKSL<br>IYSASYRYSDVPSRFSGSASGTDFTLTISSVQSEDFATYYCQQYDAP<br>MGTFGGGTKLEIK |
| 284. | PM_14xCD3-scFc | scFv | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>GGTKLEIK |
| 285. | PM_14xCD3-scFc | bispecific molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 286. | PM_14xCD3-scFc | bispecific HLE molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 287. | PM_14xCD3-scFc_delGK | bispecific HLE molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT |

TABLE 38-continued

Sequence Table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 288. | PM_14_CCxCD3-scFc | VH | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSS |
| 289. | PM_14_CCxCD3-scFc | VL | DIQMTQSPSSLSASVGDRVTITCKASQNVDTNVAWYQQKPGQAPKSL<br>IYSASYRYSDVPSRFSGSASGTDFTLTISSVQSEDFATYYCQQYDAP<br>MGTFGCGTKLEIK |
| 290. | PM_14_CCxCD3-scFc | scFv | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>CGTKLEIK |
| 291. | PM_14_CCxCD3-scFc | bispecific molecule | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 292. | PM_14_CCxCD3-scFc | bispecific HLE molecule | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 293. | PM_14_CCxCD3-scFc_deIGK | bispecific HLE molecule | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDAPMGTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL |

TABLE 38-continued

Sequence Table

| SEQ ID NO: | Designation | Format/Source | Sequence |
|---|---|---|---|
| | | | GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 294. | PM_15xCD3-scFc | VH CDR1 | DYYMN |
| 295. | PM_15xCD3-scFc | VH CDR2 | IISDNKHQTYYSDIIKG |
| 296. | PM_15xCD3-scFc | VH CDR3 | GFPLLRHGAMDY |
| 297. | PM_15xCD3-scFc | VL CDR1 | KASQNVDTNVA |
| 298. | PM_15xCD3-scFc | VL CDR2 | SASYRYS |
| 299. | PM_15xCD3-scFc | VL CDR3 | QQYDSYPYT |
| 300. | PM_15xCD3-scFc | VH | QVQLVESGGGLVKPGESLRLSCAASGFTFSDYYMNWVRQAPGKGLEW VAIISDNKHQTYYSDIIKGRFAISRDNAKNSLYLQMNSLKAEDTAVY YCARGFPLLRHGAMDYWGQGTLVTVSS |
| 301. | PM_15xCD3-scFc | VL | DIQMTQSPSSLSASVGDRVTITCKASQNVDTNVAWYQQKPGQAPKSL SRFSGSASGTDFTLTISSLQSEDFATYYCQQYDSY PYTFGGGTKLEIK |
| 302. | PM_15xCD3-scFc | scFv | QVQLVESGGGLVKPGESLRLSCAASGFTFSDYYMNWVRQAPGKGLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIK |
| 303. | PM_15xCD3-scFc | bispecific molecule | QvQLvESGGGLVKPGESLRLSCAASGFTFSDYYMNWVRQAPGKGLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 304. | PM_15xCD3-scFc | bispecific HLE molecule | QvQLvESGGGLVKPGESLRLSCAASGFTFSDYYMNWVRQAPGKGLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS |

TABLE 38-continued

Sequence Table

| SEQ ID NO: | Designation | Format/ Source | Sequence |
|---|---|---|---|
| | | | REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 305. | PM_15xCD3-scFc_delGK | bispecific HLE molecule | QvQLvESGGGLVKPGESLRLSCAASGFTFSDYYMNWVRQAPGKGLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 306. | PM_15_CCxCD3-scFc | VH | QVQLVESGGGLVKPGESLRLSCAASGFTFSDYYMNWVRQAPGKCLEW VAIISDNKHQTYYSDIIKGRFAISRDNAKNSLYLQMNSLKAEDTAVY YCARGFPLLRHGAMDYWGQGTLVTVSS |
| 307. | PM_15_CCxCD3-scFc | VL | DIQMTQSPSSLSASVGDRVTITCKASQNVDTNVAWYQQKPGQAPKSL IYSASYRYSDVPSRFSGSASGTDFTLTISSLQSEDFATYYCQQYDSY PYTFGCGTKLEIK |
| 308. | PM_15_CCxCD3-scFc | scFv | QVQLVESGGGLVKPGESLRLSCAASGFTFSDYYMNWVRQAPGKCLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG CGTKLEIK |
| 309. | PM_15_CCxCD3-scFc | bispecific molecule | QvQLvESGGGLVKPGESLRLSCAASGFTFSDYYMNWVRQAPGKCLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 310. | PM_15_CCxCD3-scFc | bispecific HLE molecule | 4v4LvESGGGLVKPGESLRLSCAASGFTFSDYYMNWVRQAPGKCLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |

TABLE 38-continued

Sequence Table

| SEQ ID NO: | Designation | Format/Source | Sequence |
|---|---|---|---|
| 311. | PM_15_CCxCD3-scFc_delGK | bispecific HLE molecule | QVQLVESGGGLVKPGESLRLSCAASGFTFSDYYMNWVRQAPGKCLEW VAIISDNKHQTYYSDIIKGRFAISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSLQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 312. | PM 76-B10.02 CC x 12C0-scFc | VH CDR1 | DYYMY |
| 313. | PM 76-B10.02 CC x 12C0-scFc | VH CDR2 | IISDAGYYTYYSDIIKG |
| 314. | PM 76-B10.02 CC x 12C0-scFc | VH CDR3 | GFPLLRHGAMDY |
| 315. | PM 76-B10.02 CC x 12C0-scFc | VL CDR1 | KASQNVDTNVA |
| 316. | PM 76-B10.02 CC x 12C0-scFc | VL CDR2 | SASYRYS |
| 317. | PM 76-B10.02 CC x 12C0-scFc | VL CDR3 | QQYESYPYT |
| 318. | PM 76-B10.02 CC x 12C0-scFc | VH | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSS |
| 319. | PM 76-B10.02 CC x 12C0-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYESY PYTFGCGTKLEIK |
| 320. | PM 76-B10.02 CC x 12C0 -scFc | scFv | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIK |
| 321. | PM 76-B10.02 CC x 12C0-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 38-continued

Sequence Table

| SEQ ID NO: | Designation | Format/ Source | Sequence |
|---|---|---|---|
| 322. | PM 76-B10.02 CC x 12C0-scFc | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 323. | PM 76-B10.02 CC x 12C0-scFc_delGK | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 324. | PM 76-B10.02 CC x 12C0 CC (103/43)-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 325. | PM 76-B10.02 CC x 12C0 CC (103/43)-scFc | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS |

TABLE 38-continued

Sequence Table

| SEQ ID NO: | Designation | Format/ Source | Sequence |
|---|---|---|---|
| | | | REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 326. | PM 76-B10.02 CC x 12C0 CC (103/43)-scFc_delGK | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYESYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 327. | PM 76-B10.08 x 12C0-scFc | VH CDR1 | DYYMY |
| 328. | PM 76-B10.08 x 12C0-scFc | VH CDR2 | IISDGGYYTYYSDIIKG |
| 329. | PM 76-B10.08 x 12C0-scFc | VH CDR3 | GFPLLRHGAMDY |
| 330. | PM 76-B10.08 x 12C0-scFc | VL CDR1 | KASQNVDTNVA |
| 331. | PM 76-B10.08 x 12C0-scFc | VL CDR2 | SASYRYS |
| 332. | PM 76-B10.08 x 12C0-scFc | VL CDR3 | QQYDQQLIT |
| 333. | PM 76-610.08 x 12C0-scFc | VH | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSS |
| 334. | PM 76-610.08 x 12C0-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDQQ LITFGGGTKLEIK |
| 335. | PM 76-B10.08 x 12C0 -scFc | scFv | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIK |
| 336. | PM 76-B10.08 x 12C0-scFc | bispecific molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |

TABLE 38-continued

Sequence Table

| SEQ ID NO: | Designation | Format/Source | Sequence |
|---|---|---|---|
| 337. | PM 76-B10.08 x 12C0-scFc | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 338. | PM 76-1310.08 x 12C0-scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 339. | PM 76-1310.08 x 12C0 CC(103/43)-scFc | bispecific molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 340. | PM 76-1310.08 x 12C0 CC(103/43)-scFc | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT |

TABLE 38-continued

Sequence Table

| SEQ ID NO: | Designation | Format/Source | Sequence |
|---|---|---|---|
| | | | VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 341. | PM 76-1310.08 x 12C0 CC (103/43)-scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 342. | PM 76-B10.08 CC x 12C0-scFc | VH CDR1 | DYYMY |
| 343. | PM 76-B10.08 CC x 12C0-scFc | VH CDR2 | IISDGGYYTYYSDIIKG |
| 344. | PM 76-B10.08 CC x 12C0-scFc | VH CDR3 | GFPLLRHGAMDY |
| 345. | PM 76-B10.08 CC x 12C0-scFc | VL CDR1 | KASQNVDTNVA |
| 346. | PM 76-B10.08 CC x 12C0-scFc | VL CDR2 | SASYRYS |
| 347. | PM 76-B10.08 CC x 12C0-scFc | VL CDR3 | QQYDQQLIT |
| 348. | PM 76-610.08 CC x 12C0-scFc | VH | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSS |
| 349. | PM 76-610.08 CC x 12C0-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDQQ LITFGCGTKLEIK |
| 350. | PM 76-B10.08 CC x 12C0-scFc | scFv | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIK |
| 351. | PM 76-B10.08 CC x 12C0-scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 38-continued

Sequence Table

| SEQ ID NO: | Designation | Format/ Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 352. | PM 76-<br>B10.08 CC x<br>12C0-scFc | bispecific<br>HLE<br>molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 353. | PM 76-<br>1310.08 CC x<br>12C0-<br>scFc_delGK | bispecific<br>HLE<br>molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 354. | PM 76-<br>1310.08 CC x<br>12C0 CC<br>(103/43)-scFc | bispecific<br>molecule | 4v4LvESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 355. | PM 76-<br>1310.08 CC x<br>12C0 CC<br>(103/43)-scFc | bispecific<br>HLE<br>molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF |

TABLE 38-continued

Sequence Table

| SEQ ID NO: | Designation | Format/ Source | Sequence |
|---|---|---|---|
| | | | SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 356. | PM 76-<br>B10.08 CC x<br>12C0 CC<br>(103/43)-<br>scFc_delGK | bispecific<br>HLE<br>molecule | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDQQLITFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 357. | PM 76-<br>610.11 x<br>12C0-scFc | VH CDR1 | DYYMY |
| 358. | PM 76-<br>610.11 x<br>12C0-scFc | VH CDR2 | IISDGGYYTYYSDIIKG |
| 359. | PM 76-<br>610.11 x<br>12C0-scFc | VH CDR3 | GFPLLRHGAMDY |
| 360. | PM 76-<br>610.11 x<br>12C0-scFc | VL CDR1 | KASQNVDTNVA |
| 361. | PM 76-<br>610.11 x<br>12C0-scFc | VL CDR2 | SASYVYW |
| 362. | PM 76-<br>610.11 x<br>12C0-scFc | VL CDR3 | QQYDQQLIT |
| 363. | PM 76-<br>610.11 x<br>12C0-scFc | VH | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSS |
| 364. | PM 76-<br>610.11 x<br>12C0-scFc | VL | DIQMTQSPSSLSASVGDRVTITCKASQNVDTNVAWYQQKPGQAPKSL<br>IYSASYVYWDVPSRFSGSASGTDFTLTISSVQSEDFATYYCQQYDQQ<br>LITFGGGTKLEIK |
| 365. | PM 76-<br>B10.11 x<br>12C0-scFc | scFv | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YVYWDVPSRFSGSASGTDFTLTISSVQSEDFATYYCQQYDQQLITFG<br>GGTKLEIK |
| 366. | PM 76-<br>B10.11 x<br>12C0-scFc | bispecific<br>molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT |

TABLE 38-continued

Sequence Table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 367. | PM 76-<br>B10.11 x<br>12C0-scFc | bispecific<br>HLE<br>molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 368. | PM 76-<br>B10.11 x<br>12C0-<br>scFc_delGK | bispecific<br>HLE<br>molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 369. | PM 76-<br>B10.11 x12C0<br>CC (103/43)-<br>scFc | bispecific<br>molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVL |
| 370. | PM 76-<br>B10.11 x12C0<br>CC (103/43)-<br>scFc | bispecific<br>HLE<br>molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF |

TABLE 38-continued

Sequence Table

| SEQ ID NO: | Designation | Format/Source | Sequence |
|---|---|---|---|
| | | | SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 371. | PM 76-B10.11 x12C0 CC (103/43)- scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 372. | PM 76-610.11 CC x 12C0-scFc | VH CDR1 | DYYMY |
| 373. | PM 76-610.11 CC x 12C0-scFc | VH CDR2 | IISDGGYYTYYSDIIKG |
| 374. | PM 76-610.11 CC x 12C0-scFc | VH CDR3 | GFPLLRHGAMDY |
| 375. | PM 76-610.11 CC x 12C0-scFc | VL CDR1 | KASQNVDTNVA |
| 376. | PM 76-610.11 CC x 12C0-scFc | VL CDR2 | SASYVYW |
| 377. | PM 76-610.11 CC x 12C0-scFc | VL CDR3 | QQYDQQLIT |
| 378. | PM 76-610.11 CC x 12C0-scFc | VH | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSS |
| 379. | PM 76-610.11 CC x 12C0-scFc | VL | DIQMTQSPSSLSASVGDRVTITCKASQNVDTNVAWYQQKPGQAPKSL IYSASYVYWDVPSRFSGSASGTDFTLTISSVQSEDFATYYCQQYDQQ LITFGCGTKLEIK |
| 380. | PM 76-B10.11 CC x 12C0-scFc | scFv | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIK |
| 381. | PM 76-B10.11 CC x 12C0-scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT |

TABLE 38-continued

Sequence Table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 382. | PM 76-B10.11 CC x 12C0-scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 383. | PM 76-B10.11 CC x 12C0-scFc_delGK | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 384. | PM 76-B10.11 CC x 12C0 CC (103/43)-scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 385. | PM76-B10.11 CC x 12C0 CC (103/43)-scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD |

TABLE 38-continued

Sequence Table

| SEQ ID NO: | Designation | Format/ Source | Sequence |
|---|---|---|---|
| | | | IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 386. | PM 76-B10.11 CC x 12C0 CC (103/43)-scFc_delGK | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 387. | PM 76-610.14 x 12C0-scFc | VH CDR1 | DYYMY |
| 388. | PM 76-610.14 x 12C0-scFc | VH CDR2 | IISDAGYYTYYSDIIKG |
| 389. | PM 76-610.14 x 12C0-scFc | VH CDR3 | GFPLLRHGAMDY |
| 390. | PM 76-610.14 x 12C0-scFc | VL CDR1 | KASQNVDANVA |
| 391. | PM 76-610.14 x 12C0-scFc | VL CDR2 | SASYRYS |
| 392. | PM 76-610.14 x 12C0-scFc | VL CDR3 | QQYDQQLIT |
| 393. | PM 76-610.14 x 12C0-scFc | VH | QVQLVESGGGLVKPGESLRLSCAASGFTFSDYYMYWVRQAPGKGLEW VAIISDAGYYTYYSDIIKGRFTISRDNAKNSLYLQMNSLKAEDTAVY YCARGFPLLRHGAMDYWGQGTLVTVSS |
| 394. | PM 76-610.14 x 12C0-scFc | VL | DIQMTQSPSSLSASVGDRVTITCKASQNVDANVAWYQQKPGQAPKSL IYSASYRYSDVPSRFSGSASGTDFTLTISSVQSEDFATYYCQQYDQQ LITFGGGTKLEIK |
| 395. | PM 76-B10.14 x 12C0-scFc | scFv | QVQLVESGGGLVKPGESLRLSCAASGFTFSDYYMYWVRQAPGKGLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG GGTKLEIK |
| 396. | PM 76-B10.14 x 12C0-scFc | bispecific molecule | QVQLVESGGGLVKPGESLRLSCAASGFTFSDYYMYWVRQAPGKGLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA |

TABLE 38-continued

Sequence Table

| SEQ ID NO: | Designation | Format/ Source | Sequence |
|---|---|---|---|
| | | | MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 397. | PM 76-<br>B10.14 x<br>12C0-scFc | bispecific/<br>HLE<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YRYSDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 398. | PM 76-<br>B10.14 x<br>12C0-<br>scFc_delGK | bispecific<br>HLE<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YRYSDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 399. | PM 76-<br>B10.14 x12C0<br>CC (103/43)-<br>scFc | bispecific<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YRYSDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVL |
| 400. | PM 76-<br>B10.14 x12C0<br>CC (103/43)-<br>scFc | bispecific<br>HLE<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YRYSDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP |

TABLE 38-continued

Sequence Table

| SEQ ID NO: | Designation | Format/ Source | Sequence |
|---|---|---|---|
| | | | APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 401. | PM 76- B10.14 x12C0 CC (103/43)- scFc_delGK | bispecific HLE molecule | QVQLVESGGGLVKPGESLRLSCAASGFTFSDYYMYWVRQAPGKGLEW VAIISDAGYYTYYSDIIKGRFTISRDNAKNSLYLQMNSLKAEDTAVY YCARGFPLLRHGAMDYWGQTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 402. | PM 76- 610.14 CC x 12C0-scFc | VH CDR1 | DYYMY |
| 403. | PM 76- 610.14 CC x 12C0-scFc | VH CDR2 | IISDAGYYTYYSDIIKG |
| 404. | PM 76- 610.14 CC x 12C0-scFc | VH CDR3 | GFPLLRHGAMDY |
| 405. | PM 76- 610.14 CC x 12C0-scFc | VL CDR1 | KASQNVDANVA |
| 406. | PM 76- 610.14 CC x 12C0-scFc | VL CDR2 | SASYRYS |
| 407. | PM 76- 610.14 CC x 12C0-scFc | VL CDR3 | QQYDQQLIT |
| 408. | PM 76- 610.14 CC x 12C0-scFc | VH | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQTLVTVSS |
| 409. | PM 76- 610.14 CC x 12C0-scFc | VL | DIQMTQSPSSLSASVGDRVTITCKASQNVDANVAWYQQKPGQAPKSL IYSASYRYSDVPSRFSGSASGTDFTLTISSVQSEDFATYYCQQYDQQ LITFGCGTKLEIK |
| 410. | PM 76- B10.14 CC x 12C0-scFc | scFv | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG CGTKLEIK |
| 411. | PM 76- B10.14 CC x 12C0-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG |

TABLE 38-continued

Sequence Table

| SEQ ID NO: | Designation | Format/ Source | Sequence |
|---|---|---|---|
| | | | CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 412. | PM 76-1310.14 CC x 12C0-scFc | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 413. | PM 76-1310.14 CC x 12C0-scFc_delGK | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 414. | PM 76-1310.14 CC x 12C0 CC (103/43)-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 415. | PM 76-1310.14 CC x 12C0 CC (103/43)-scFc | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YRYSDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV |

TABLE 38-continued

Sequence Table

| SEQ ID NO: | Designation | Format/ Source | Sequence |
|---|---|---|---|
| | | | EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 416. | PM 76-<br>B10.14 CC x<br>12C0 CC<br>(103/43)-<br>scFc_delGK | bispecific<br>HLE<br>molecule | QVQLVESGGGLVKPGESLRLSCAASGFTFSDYYMYWVRQAPGKCLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YRYSDVPSRFSGSASGTDFTLTISSVQSEDFATYYCQQYDQQLITFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 417. | PM 76-<br>610.17 x<br>12C0-scFc | VH CDR1 | DYYMY |
| 418. | PM 76-<br>610.17 x<br>12C0-scFc | VH CDR2 | IISDAGYYTYYSDIIKG |
| 419. | PM 76-<br>610.17 x<br>12C0-scFc | VH CDR3 | GFPLLRHGAMDY |
| 420. | PM 76-<br>610.17 x<br>12C0-scFc | VL CDR1 | KASQNVDANVA |
| 421. | PM 76-<br>610.17 x<br>12C0-scFc | VL CDR2 | SASYVYW |
| 422. | PM 76-<br>610.17 x<br>12C0-scFc | VL CDR3 | QQYDQQLIT |
| 423. | PM 76-<br>610.17 x<br>12C0-scFc | VH | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>CARGFPLLRHGAMDYWGQGTLVTVSS |
| 424. | PM 76-<br>610.17 x<br>12C0-scFc | VL | DIQMTQSPSSLSASVGDRVTITCKASQNVDANVAWYQQKPGQAPKSL<br>IYSASYVYWDVPSRFSGSASGTDFTLTISSVQSEDFATYYCQQYDQQ<br>LITFGGGTKLEIK |
| 425. | PM 76-<br>B10.17 x<br>12C0-scFc | scFv | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YVYWDVPSRFSGSASGTDFTLTISSVQSEDFATYYCQQYDQQLITFG<br>GGTKLEIK |
| 426. | PM 76-<br>B10.17 x<br>12C0-scFc | bispecific<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS |

TABLE 38-continued

Sequence Table

| SEQ ID NO: | Designation | Format/ Source | Sequence |
|---|---|---|---|
| | | | YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVL |
| 427. | PM 76-<br>B10.17 x<br>12C0-scFc | bispecific<br>HLE<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 428. | PM 76-<br>B10.17 x<br>12C0-<br>scFc_delGK | bispecific<br>HLE<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYWGQGTLVTVSSGG<br>GGSGGGGSGGGGSQTVVTQEPSLTVSPGGTVTLTCGSSTGAVTSGNY<br>PNWVQQKPGQAPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 429. | PM 76-<br>B10.17 x12C0<br>CC (103/43)-<br>scFc | bispecific<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVL |
| 430. | PM 76-<br>B10.17 x12C0<br>CC (103/43)-<br>scFc | bispecific<br>HLE<br>molecule | QVQLVESGGGLVKPGESLRLSCAASGFTFSDYYMYWVRQAPGKGLEW<br>VAIISDAGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDANVAWYQQKPGQAPKSLIYSAS<br>YVYWDVPSRFSGSASGTDFTLTISSVQSEDFATYYCQQYDQQLITFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGGDKTHTCPPCPAPELL |

TABLE 38-continued

Sequence Table

| SEQ ID NO: | Designation | Format/ Source | Sequence |
|---|---|---|---|
| | | | GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 431. | PM 76- B10.17 x12C0 CC (103/43)- scFc_delGK | bispecific HLE molecule | QVQLVESGGGLVKPGESLRLSCAASGFTFSDYYMYWVRQAPGKGLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 432. | PM 76- 610.17 CC x 12C0-scFc | VH CDR1 | DYYMY |
| 433. | PM 76- 610.17 CC x 12C0-scFc | VH CDR2 | IISDAGYYTYYSDIIKG |
| 434. | PM 76- 610.17 CC x 12C0-scFc | VH CDR3 | GFPLLRHGAMDY |
| 435. | PM 76- 610.17 CC x 12C0-scFc | VL CDR1 | KASQNVDANVA |
| 436. | PM 76- 610.17 CC x 12C0-scFc | VL CDR2 | SASYVYW |
| 437. | PM 76- 610.17 CC x 12C0-scFc | VL CDR3 | QQYDQQLIT |
| 438. | PM 76- 610.17 CC x 12C0-scFc | VH | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSS |
| 439. | PM 76- 610.17 CC x 12C0-scFc | VL | DIQMTQSPSSLSASVGDRVTITCKASQNVDANVAWYQQKPGQAPKSL IYSASYVYWDVPSRFSGSASGTDFTLTISSVQSEDFATYYCQQYDQQ LITFGCGTKLEIK |
| 440. | PM 76- B10.17 CC x 12C0-scFc | scFv | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIK |
| 441. | PM 76- B10.17 CC x 12C0-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT |

TABLE 38-continued

Sequence Table

| SEQ ID NO: | Designation | Format/Source | Sequence |
|---|---|---|---|
| | | | QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 442. | PM 76-B10.17 CC x 12C0-scFc | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 443. | PM 76-B10.17 CC x 12C0-scFc_delGK | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 444. | PM 76-1310.17 CC x 12C0 CC (103/43)-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 445. | PM 76-1310.17 CC x 12C0 CC (103/43)-scFc | bispecific molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ |

TABLE 38-continued

Sequence Table

| SEQ ID NO: | Designation | Format/ Source | Sequence |
|---|---|---|---|
| | | | PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 446. | PM 76-1310.17 CC x 12C0 CC (103/43)-scFc_delGK | bispecific HLE molecule | QVQLVESGGGLVKPGESLRLSCAASGFTFSDYYMYWVRQAPGKCLEW VAIISDAGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDANVAWYQQKPGQAPKSLIYSAS YVYWDVPSRFSGSASGTDFTLTISSVQSEDFATYYCQQYDQQLITFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 447. | PM 76-1310 x 12C0-scFc | VH CDR1 | DYYMY |
| 448. | PM 76-610 x 12C0-scFc | VH CDR2 | IISDGGYYTYYSDIIKG |
| 449. | PM 76-1310 x 12C0-scFc | VH CDR3 | GFPLLRHGAMDY |
| 450. | PM 76-610 x 12C0-scFc | VL CDR1 | KASQNVDTNVA |
| 451. | PM 76-1310 x 12C0-scFc | VL CDR2 | SASYRS |
| 452. | PM 76-1310 x 12C0-scFc | V L CDR3 | QQYDSYPYT |
| 453. | PM 76-1310 x 12C0-scFc | VH | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSS |
| 454. | PM 76-1310 x 12C0-scFc | VL | DIQMTQSPSSLSASVGDRVTITCKASQNVDTNVAWYQQKPGQAPKSL IYSASYRYSDVPSRFSGSASGTDFTLTISSVQSEDFATYYCQQYDSY PYTFGGGTKLEIK |
| 455. | PM 76-1310 x 12C0-scFc | scFv | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIK |
| 456. | PM 76-1310 x 12C0-scFc | bispecific molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG |

TABLE 38-continued

Sequence Table

| SEQ ID NO: | Designation | Format/Source | Sequence |
|---|---|---|---|
| | | | GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 457. | PM 76-1310 x 12C0-scFc | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 458. | PM 76-1310 x 12C0-scFc_delGK | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 459. | PM 76-1310 x 12C0 CC (103/43)-scFc | bispecific molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 460. | PM 76-1310 x 12C0 CC (103/43)-scFc | bispecific HLE molecule | QVQLVESGGGLVKPGESLRLSCAASGFTFSDYYMYWVRQAPGKGLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG GGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF |

TABLE 38-continued

Sequence Table

| SEQ ID NO: | Designation | Format/ Source | Sequence |
|---|---|---|---|
| | | | SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 461. | PM 76-1310 x<br>12C0 CC<br>(103/43)-<br>scFc_delGK | bispecific<br>HLE<br>molecule | QVQLVESGGGLVKPGESLRLSCAASGFTFSDYYMYWVRQAPGKGLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDSYPYTFG<br>GGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 462. | PM 76-1310<br>CC x 12C0-<br>scFc | VH CDR1 | DYYMY |
| 463. | PM 76-1310<br>CC x 12C0-<br>scFc | VH CDR2 | IISDGGYYTYYSDIIKG |
| 464. | PM 76-1310<br>CC x 12C0-<br>scFc | VH CDR3 | GFPLLRHGAMDY |
| 465. | PM 76-1310<br>CC x 12C0-<br>scFc | VL CDR1 | KASQNVDTNVA |
| 466. | PM 76-1310<br>CC x 12C0-<br>scFc | VL CDR2 | SASYRYS |
| 467. | PM 76-1310<br>CC x 12C0-<br>scFc | VL CDR3 | QQYDSYPYT |
| 468. | PM 76-1310<br>CC x 12C0-<br>ScFc | VH | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSS |
| 469. | PM 76-1310<br>CC x 12C0-<br>ScFc | VL | DIQMTQSPSSLSASVGDRVTITCKASQNVDTNVAWYQQKPGQAPKSL<br>IYSASYRYSDVPSRFSGSASGTDFTLTISSVQSEDFATYYCQQYDSY<br>PYTFGCGTKLEIK |
| 470. | PM 76-1310<br>CC x 12C0-<br>scFc | scFv | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDSYPYTFG<br>CGTKLEIK |
| 471. | PM 76-1310<br>CC x 12C0-<br>scFc | bispecific<br>molecule | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT |

TABLE 38-continued

Sequence Table

| SEQ ID NO: | Designation | Format/ Source | Sequence |
|---|---|---|---|
| | | | AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVL |
| 472. | PM 76-1310 CC x12C0-scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGKGGGGSGGGGSGGGGSGGGGSGGG GSGGGGSDKTHTCPPCPAPELLGGPSVFLFPPKPKDTLMISRTPEVT CVVVDVSHEDPEVKFNWYVDGVEVHNAKTKPCEEQYGSTYRCVSVLT VLHQDWLNGKEYKCKVSNKALPAPIEKTISKAKGQPREPQVYTLPPS REEMTKNQVSLTCLVKGFYPSDIAVEWESNGQPENNYKTTPPVLDSD GSFFLYSKLTVDKSRWQQGNVFSCSVMHEALHNHYTQKSLSLSPGK |
| 473. | PM76-610 CC x12C0-scFc_delGK | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYWGQGTLVTVSSGG GGSGGGGSGGGGSQTVVTQEPSLTVSPGGTVTLTCGSSTGAVTSGNY PNWVQQKPGQAPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF SCSVMHEALHNHYTQKSLSLSPGGGGSGGGGSGGGGSGGGGSGGGGS GGGGSDKTHTCPPCPAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 474. | PM 76-610 CC x 12C0 CC (103/43)-scFc | bispecific molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVL |
| 475. | PM76-610 CC x 12C0 CC (103/43)-scFc | bispecific HLE molecule | QVQLVESGGGLVKPGESLRLSCAASGFTFSDYYMYWVRQAPGKCLEW VAIISDGGYYTYYSDIIKGRFTISRDNAKNSLYLQMNSLKAEDTAVY YCARGFPLLRHGAMDYWGQGTLVTVSSGGGGSGGGGSGGGGSDIQMT QSPSSLSASVGDRVTITCKASQNVDTNVAWYQQKPGQAPKSLIYSAS YRYSDVPSRFSGSASGTDFTLTISSVQSEDFATYYCQQYDSYPYTFG CGTKLEIKSGGGGSEVQLVESGGGLVQPGGSLKLSCAASGFTFNKYA MNWVRQAPGKGLEWVARIRSKYNNYATYYADSVKDRFTISRDDSKNT AYLQMNNLKTEDTAVYYCVRHGNFGNSYISYWAYCGQGTLVTVSSGG GGSGGGGSGGGGSQTVVTQEPSLTVSPGGTVTLTCGSSTGAVTSGNY PNWVQQKPGQCPRGLIGGTKFLAPGTPARFSGSLLGGKAALTLSGVQ PEDEAEYYCVLWYSNRWVFGGGTKLTVLGGGGDKTHTCPPCPAPELL GGPSVFLFPPKPKDTLMISRTPEVTCVVVDVSHEDPEVKFNWYVDGV EVHNAKTKPCEEQYGSTYRCVSVLTVLHQDWLNGKEYKCKVSNKALP APIEKTISKAKGQPREPQVYTLPPSREEMTKNQVSLTCLVKGFYPSD IAVEWESNGQPENNYKTTPPVLDSDGSFFLYSKLTVDKSRWQQGNVF |

TABLE 38-continued

Sequence Table

| SEQ ID NO: | Designation | Format/ Source | Sequence |
|---|---|---|---|
| | | | SCSVMHEALHNHYTQKSLSLSPGKGGGGSGGGGSGGGGSGGGGSGGG<br>GSGGGGSDKTHTCPPCPAPELLGGPSVFLFPPKPKDTLMISRTPEVT<br>CVVVDVSHEDPEVKFNWYVDGVEVHNAKTKPCEEQYGSTYRCVSVLT<br>VLHQDWLNGKEYKCKVSNKALPAPIEKTISKAKGQPREPQVYTLPPS<br>REEMTKNQVSLTCLVKGFYPSDIAVEWESNGQPENNYKTTPPVLDSD<br>GSFFLYSKLTVDKSRWQQGNVFSCSVMHEALHNHYTQKSLSLSPGK |
| 476. | PM 76-1310<br>CC x 12C0 CC<br>(103/43)-<br>scFc_delGK | bispecific<br>HLE<br>molecule | QVQLVESGGGLVKPGESLRLSCAASGFTFSDYYMYWVRQAPGKCLEW<br>VAIISDGGYYTYYSDIIKGRFTISRDNAKNSLYLQMNSLKAEDTAVY<br>YCARGFPLLRHGAMDYWGQGTLVTVSSGGGGSGGGGSGGGGSDIQMT<br>QSPSSLSASVGDRVTITCKASQNVDTNVAWYQQKPGQAPKSLIYSAS<br>YRYSDVPSRFSGSASGTDFTLTISSVQSEDFATYYCQQYDSYPYTFG<br>CGTKLEIKSGGGGSEVQLVESGGGLVQPGGSLKLSCAASGFTFNKYA<br>MNWVRQAPGKGLEWVARIRSKYNNYATYYADSVKDRFTISRDDSKNT<br>AYLQMNNLKTEDTAVYYCVRHGNFGNSYISYWAYCGQGTLVTVSSGG<br>GGSGGGGSGGGGSQTVVTQEPSLTVSPGGTVTLTCGSSTGAVTSGNY<br>PNWVQQKPGQCPRGLIGGTKFLAPGTPARFSGSLLGGKAALTLSGVQ<br>PEDEAEYYCVLWYSNRWVFGGGTKLTVLGGGGDKTHTCPPCPAPELL<br>GGPSVFLFPPKPKDTLMISRTPEVTCVVVDVSHEDPEVKFNWYVDGV<br>EVHNAKTKPCEEQYGSTYRCVSVLTVLHQDWLNGKEYKCKVSNKALP<br>APIEKTISKAKGQPREPQVYTLPPSREEMTKNQVSLTCLVKGFYPSD<br>IAVEWESNGQPENNYKTTPPVLDSDGSFFLYSKLTVDKSRWQQGNVF<br>SCSVMHEALHNHYTQKSLSLSPGGGGSGGGGSGGGGSGGGGSGGGGS<br>GGGGSDKTHTCPPCPAPELLGGPSVFLFPPKPKDTLMISRTPEVTCV<br>VVDVSHEDPEVKFNWYVDGVEVHNAKTKPCEEQYGSTYRCVSVLTVL<br>HQDWLNGKEYKCKVSNKALPAPIEKTISKAKGQPREPQVYTLPPSRE<br>EMTKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 477. | IgG1 hinge | | DKTHTCPPCP |
| 478. | IgG2 hinge | | ERKCCVECPPCP |
| 479. | IgG3 hinge | | ELKTPLDTTHTCPRCP |
| 480. | IgG4 hinge | | ESKYGPPCPSCP |
| 481. | EGFRvIIIccx12<br>C-Hinge-CH2-<br>CH3-linker-<br>hinge-CH2-<br>CH3<br>(DF9) | bispecific<br>HLE<br>molecule | QVQLVESGGGVVQSGRSLRLSCAASGFTFRNYGMHWVRQAPGKCLEW<br>VAVIWYDGSDKYYADSVRGRFTISRDNSKNTLYLQMNSLRAEDTAVY<br>YCARDGYDILTGNPRDFDYWGQGTLVTVSSGGGGSGGGGSGGGGSDT<br>VMTQTPLSSHVTLGQPASISCRSSQSLVHSDGNTYLSWLQQRPGQPP<br>RLLIYRISRRFSGVPDRFSGSGAGTDFTLEISRVEAEDVGVYYCMQS<br>THVPRTFGCGTKVEIKSGGGGSEVQLVESGGGLVQPGGSLKLSCAAS<br>GFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGT<br>LVTVSSGGGGSGGGGSGGGGSQTVVTQEPSLTVSPGGTVTLTCGSST<br>GAVTSGNYPNWVQQKPGQAPRGLIGGTKFLAPGTPARFSGSLLGGKA<br>ALTLSGVQPEDEAEYYCVLWYSNRWVFGGGTKLTVLGGGGDKTHTCP<br>PCPAPELLGGPSVFLFPPKPKDTLMISRTPEVTCVVVDVSHEDPEVK<br>FNWYVDGVEVHNAKTKPCEEQYGSTYRCVSVLTVLHQDWLNGKEYKC<br>KVSNKALPAPIEKTISKAKGQPREPQVYTLPPSREEMTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGKGGGGSGGGGSGGGGS<br>GGGGSGGGGSGGGGSDKTHTCPPCPAPELLGGPSVFLFPPKPKDTLM<br>ISRTPEVTCVVVDVSHEDPEVKFNWYVDGVEVHNAKTKPCEEQYGST<br>YRCVSVLTVLHQDWLNGKEYKCKVSNKALPAPIEKTISKAKGQPREP<br>QVYTLPPSREEMTKNQVSLTCLVKGFYPSDIAVEWESNGQPENNYKT<br>TPPVLDSDGSFFLYSKLTVDKSRWQQGNVFSCSVMHEALHNHYTQKS<br>LSLSPGK |
| 482. | EGFRvIIIccx12<br>C-Hinge-CH2-<br>CH3-linker-<br>CH2-CH3<br>(T2G) | bispecific<br>HLE<br>molecule | QvQLvESGGGVVQSGRSLRLSCAASGFTFRNYGMHWVRQAPGKCLEW<br>VAVIWYDGSDKYYADSVRGRFTISRDNSKNTLYLQMNSLRAEDTAVY<br>YCARDGYDILTGNPRDFDYWGQGTLVTVSSGGGGSGGGGSGGGGSDT<br>VMTQTPLSSHVTLGQPASISCRSSQSLVHSDGNTYLSWLQQRPGQPP<br>RLLIYRISRRFSGVPDRFSGSGAGTDFTLEISRVEAEDVGVYYCMQS<br>THVPRTFGCGTKVEIKSGGGGSEVQLVESGGGLVQPGGSLKLSCAAS<br>GFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGT<br>LVTVSSGGGGSGGGGSGGGGSQTVVTQEPSLTVSPGGTVTLTCGSST<br>GAVTSGNYPNWVQQKPGQAPRGLIGGTKFLAPGTPARFSGSLLGGKA<br>ALTLSGVQPEDEAEYYCVLWYSNRWVFGGGTKLTVLGGGGDKTHTCP<br>PCPAPELLGGPSVFLFPPKPKDTLMISRTPEVTCVVVDVSHEDPEVK<br>FNWYVDGVEVHNAKTKPCEEQYGSTYRCVSVLTVLHQDWLNGKEYKC<br>KVSNKALPAPIEKTISKAKGQPREPQVYTLPPSREEMTKNQVSLTCL<br>VKGFYPSDIAVEWESNGQPENNYKTTPPVLDSDGSFFLYSKLTVDKS<br>RWQQGNVFSCSVMHEALHNHYTQKSLSLSPGKGGGGSGGGGSGGGGS |

TABLE 38-continued

Sequence Table

| SEQ ID NO: | Designation | Format/ Source | Sequence |
|---|---|---|---|
| | | | GGGGSGGGGSGGGGSAPELLGGPSVFLFPPKPKDTLMISRTPEVTCV VVDVSHEDPEVKFNWYVDGVEVHNAKTKPCEEQYGSTYRCVSVLTVL HQDWLNGKEYKCKVSNKALPAPIEKTISKAKGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |
| 483. | EGFRvIIIccx12 C-Hinge-CH2-linker-Hinge-CH2-CH3-linker-CH3 (D3L) | bispecific HLE molecule | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGGGGSGGGGSGGGGSGGGGSDKTHTCPP CPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCK VSNKALPAPIEKTISKAKGQPREPQVYTLPPSREEMTKNQVSLTCLV KGFYPSDIAVEWESNGQPENNYKTTPPVLDSDGSFFLYSKLTVDKSR WQQGNVFSCSVMHEALHNHYTQKSLSLSPGKGGGGSGGGGSGGGGSG GGGSGQPREPQVYTLPPSREEMTKNQVSLTCLVKGFYPSDIAVEWES NGQPENNYKTTPPVLDSDGSFFLYSKLTVDKSRWQQGNVFSCSVMHE ALHNHYTQKSLSLSPGK |
| 484. | EGFRvIIIccx12 C-Hinge-CH2-linker-CH2-CH3-linker-CH3 (T7I) | bispecific HLE molecule | QvQLvESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGDKTHTCP PCPAPELLGGPSVFLFPPKPKDTLMISRTPEVTCVVVDVSHEDPEVK FNWYVDGVEVHNAKTKPCEEQYGSTYRCVSVLTVLHQDWLNGKEYKC KVSNKALPAPIEKTISKAKGGGGSGGGGSGGGGSGGGGSAPELLGGP SVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAV EWESNGQPENNYKTTPPVLDSDGSFFLYSKLTVDKSRWQQGNVFSCS VMHEALHNHYTQKSLSLSPGKGGGGSGGGGSGGGGSGGGGSGQPREP QVYTLPPSREEMTKNQVSLTCLVKGFYPSDIAVEWESNGQPENNYKT TPPVLDSDGSFFLYSKLTVDKSRWQQGNVFSCSVMHEALHNHYTQKS LSLSPGK |
| 485. | EGFRvIIIccx12 C-CH2-linker-CH2-CH3-linker-CH3 (K6C) | bispecific HLE molecule | QVQLVESGGGVVQSGRSLRLSCAASGFTFRNYGMHWVRQAPGKCLEW VAVIWYDGSDKYYADSVRGRFTISRDNSKNTLYLQMNSLRAEDTAVY YCARDGYDILTGNPRDFDYWGQGTLVTVSSGGGGSGGGGSGGGGSDT VMTQTPLSSHVTLGQPASISCRSSQSLVHSDGNTYLSWLQQRPGQPP RLLIYRISRRFSGVPDRFSGSGAGTDFTLEISRVEAEDVGVYYCMQS THVPRTFGCGTKVEIKSGGGGSEVQLVESGGGLVQPGGSLKLSCAAS GFTFNKYAMNWVRQAPGKGLEWVARIRSKYNNYATYYADSVKDRFTI SRDDSKNTAYLQMNNLKTEDTAVYYCVRHGNFGNSYISYWAYWGQGT LVTVSSGGGGSGGGGSGGGGSQTVVTQEPSLTVSPGGTVTLTCGSST GAVTSGNYPNWVQQKPGQAPRGLIGGTKFLAPGTPARFSGSLLGGKA ALTLSGVQPEDEAEYYCVLWYSNRWVFGGGTKLTVLGGGGAPELLGG PSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGGGGSGGGGSGGGGSGGGGSAPELLGGPSVFLFPPKPK DTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQ PREPQVYTLPPSREEMTKNQVSLTCLVKGFYPSDIAVEWESNGQPEN NYKTTPPVLDSDGSFFLYSKLTVDKSRWQQGNVFSCSVMHEALHNHY TQKSLSLSPGKGGGGSGGGGSGGGGSGGGGSGQPREPQVYTLPPSRE EMTKNQVSLTCLVKGFYPSDIAVEWESNGQPENNYKTTPPVLDSDGS FFLYSKLTVDKSRWQQGNVFSCSVMHEALHNHYTQKSLSLSPGK |

TABLE 38-continued

Sequence Table

| SEQ ID NO: | Designation | Format/Source | Sequence |
|---|---|---|---|
| 486. | IgG3 hinge | | ELKTPLGDTTHTCPRCP |
| 487. | IgG1 hinge | | EPKSCDKTHTCPPCP |

SEQUENCE LISTING (586 sequences)

SEQ ID NO: 1 - protein, 5 aa, Artificial Sequence
  Synthetic peptide
GGGGS

SEQ ID NO: 2 - protein, 10 aa, Artificial Sequence
  Synthetic peptide
GGGGSGGGGS

SEQ ID NO: 3 - protein, 15 aa, Artificial Sequence
  Synthetic peptide
GGGGSGGGGSGGGGS

SEQ ID NO: 4 - protein, 20 aa, Artificial Sequence
  Synthetic peptide
GGGGSGGGGSGGGGSGGGGS

SEQ ID NO: 5 - protein, 25 aa, Artificial Sequence
  Synthetic peptide
GGGGSGGGGSGGGGSGGGGSGGGGS

SEQ ID NO: 6 - protein, 30 aa, Artificial Sequence
  Synthetic peptide
GGGGSGGGGSGGGGSGGGGSGGGGSGGGGS

SEQ ID NO: 7 - protein, 35 aa, Artificial Sequence
  Synthetic peptide
GGGGSGGGGSGGGGSGGGGSGGGGSGGGGSGGGGS

SEQ ID NO: 8 - protein, 40 aa, Artificial Sequence
  Synthetic peptide
GGGGSGGGGSGGGGSGGGGSGGGGSGGGGSGGGGSGGGGS

SEQ ID NO: 9 - protein, 6 aa, Artificial Sequence
  Synthetic peptide
PGGGGS

SEQ ID NO: 10 - protein, 6 aa, Artificial Sequence
  Synthetic peptide
PGGDGS

SEQ ID NO: 11 - protein, 6 aa, Artificial Sequence
  Synthetic peptide
SGGGGS

SEQ ID NO: 12 - protein, 4 aa, Artificial Sequence
  Synthetic peptide
GGGG

SEQ ID NO: 13 - protein, 109 aa, Artificial Sequence
  Synthetic peptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 14 - protein, 125 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 15 - protein, 249 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 16 - protein, 6 aa, Artificial Sequence
  Synthetic peptide
HHHHHH

SEQ ID NO: 17 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 19 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 21 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 23 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 225 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 27 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 29 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 31 - protein, 484 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 480 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 33 - protein, 725 aa, Artificial Sequence
  Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 34 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 35 - protein, 1091 aa, Artificial Sequence
  Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 36 - protein, 571 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 37 - protein, 577 aa, Artificial Sequence
  Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 38 - protein, 732 aa, Artificial Sequence
  Synthetic peptide
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 39 - protein, 227 aa, Artificial Sequence; identical to SEQ ID NO: 34
  Synthetic peptide

SEQ ID NO: 40 - protein, 736 aa, Artificial Sequence
  Synthetic peptide
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 41 - protein, 227 aa, Artificial Sequence; identical to SEQ ID NO: 34
  Synthetic peptide

SEQ ID NO: 42 - protein, 5 aa, Artificial Sequence
  Synthetic peptide
DYYMN

SEQ ID NO: 43 - protein, 17 aa, Artificial Sequence
  Synthetic peptide
IISDGGYYTYYSDIIKG

SEQ ID NO: 44 - protein, 12 aa, Artificial Sequence
  Synthetic peptide
GFPLLRHGAMDY

SEQ ID NO: 45 - protein, 11 aa, Artificial Sequence
  Synthetic peptide
KASQNVDTNVA

SEQ ID NO: 46 - protein, 7 aa, Artificial Sequence
  Synthetic peptide
SASYRYS

SEQ ID NO: 47 - protein, 9 aa, Artificial Sequence
  Synthetic peptide
QQYDSYPYT

SEQ ID NO: 48 - protein, 121 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 49 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIK

SEQ ID NO: 50 - protein, 243 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIK

SEQ ID NO: 51 - protein, 498 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 52 - protein, 986 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 984 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 121 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSS

SEQ ID NO: 55 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIK

SEQ ID NO: 56 - protein, 243 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIK

SEQ ID NO: 57 - protein, 498 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 58 - protein, 986 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 984 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 5 aa, Artificial Sequence
  Synthetic peptide
DYYMY

SEQ ID NO: 61 - protein, 17 aa, Artificial Sequence
  Synthetic peptide
IISDAGGLTYYSDIIKG

SEQ ID NO: 62 - protein, 12 aa, Artificial Sequence
  Synthetic peptide
GFPLLRHGAMDY

SEQ ID NO: 63 - protein, 11 aa, Artificial Sequence
  Synthetic peptide
KASQNVDTNVA

SEQ ID NO: 64 - protein, 7 aa, Artificial Sequence
  Synthetic peptide
SASYRYS

SEQ ID NO: 65 - protein, 9 aa, Artificial Sequence
  Synthetic peptide
QQYDSYPYT

SEQ ID NO: 66 - protein, 121 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSS

SEQ ID NO: 67 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 68 - protein, 243 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 69 - protein, 498 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 70 - protein, 986 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 984 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 121 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSS

SEQ ID NO: 73 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 74 - protein, 243 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 75 - protein, 498 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 76 - protein, 986 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 984 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 5 aa, Artificial Sequence
  Synthetic peptide
DYYMY

SEQ ID NO: 79 - protein, 17 aa, Artificial Sequence
  Synthetic peptide
IISDAGGLTYYSDIIKG

SEQ ID NO: 80 - protein, 12 aa, Artificial Sequence
  Synthetic peptide
GFPLLRHGAMDY

SEQ ID NO: 81 - protein, 11 aa, Artificial Sequence
  Synthetic peptide
KASQNVDTNVA

SEQ ID NO: 82 - protein, 7 aa, Artificial Sequence
  Synthetic peptide
SASYRYS

SEQ ID NO: 83 - protein, 9 aa, Artificial Sequence
  Synthetic peptide
QQYDDLRPT

SEQ ID NO: 84 - protein, 121 aa, Artificial Sequence; identical to SEQ ID NO: 66
  Synthetic peptide

SEQ ID NO: 85 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIK

SEQ ID NO: 86 - protein, 243 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIK

SEQ ID NO: 87 - protein, 498 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 88 - protein, 986 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 984 aa, Artificial Sequence
  Synthetic peptide
QVQLVESGGGLVKPGESLRLSCAASGFTFSDYYMYWVRQAPGKGLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 121 aa, Artificial Sequence; identical to SEQ ID NO: 72
  Synthetic peptide

SEQ ID NO: 91 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIK

SEQ ID NO: 92 - protein, 243 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIK

SEQ ID NO: 93 - protein, 498 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 94 - protein, 986 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 984 aa, Artificial Sequence
  Synthetic peptide
QVQLVESGGGLVKPGESLRLSCAASGFTFSDYYMYWVRQAPGKCLEWVAIISDAGGLTYYSDIIKGRFTISRDNAKNSLYLQINSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 5 aa, Artificial Sequence
  Synthetic peptide
DYYMY

SEQ ID NO: 97 - protein, 17 aa, Artificial Sequence
  Synthetic peptide
IISDHYSHTYYSDIIKD

SEQ ID NO: 98 - protein, 12 aa, Artificial Sequence
  Synthetic peptide
GFPLLRHGAMDY

SEQ ID NO: 99 - protein, 11 aa, Artificial Sequence
  Synthetic peptide
KASQNVDTNVA

SEQ ID NO: 100 - protein, 7 aa, Artificial Sequence
  Synthetic peptide
SASYRYS

SEQ ID NO: 101 - protein, 9 aa, Artificial Sequence
  Synthetic peptide
QQYDSYPYT

SEQ ID NO: 102 - protein, 121 aa, Artificial Sequence
  Synthetic peptide
QVQLVESGGGLVKPGESLRLSCAASGFTFSDYYMYWVRQAPGKGLEWVAIISDHYSHTYYSDIIKDRFTISRDNAKNSLYLQMNSLKAEDTAVYYCARGFPLLRHGAMDYWGQGTLVTVSS

SEQ ID NO: 103 - protein, 107 aa, Artificial Sequence; identical to SEQ ID NO: 67
  Synthetic peptide

SEQ ID NO: 104 - protein, 243 aa, Artificial Sequence
  Synthetic peptide
QVQLVESGGGLVKPGESLRLSCAASGFTFSDYYMYWVRQAPGKGLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 105 - protein, 498 aa, Artificial Sequence
  Synthetic peptide
QVQLVESGGGLVKPGESLRLSCAASGFTFSDYYMYWVRQAPGKGLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 106 - protein, 986 aa, Artificial Sequence
  Synthetic peptide
QVQLVESGGGLVKPGESLRLSCAASGFTFSDYYMYWVRQAPGKGLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 984 aa, Artificial Sequence
  Synthetic peptide
QVQLVESGGGLVKPGESLRLSCAASGFTFSDYYMYWVRQAPGKGLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 121 aa, Artificial Sequence
  Synthetic peptide
QVQLVESGGGLVKPGESLRLSCAASGFTFSDYYMYWVRQAPGKCLEWVAIISDHYSHTYYSDIIKDRFTISRDNAKNSLYLQMNSLKAEDTAVYYCARGFPLLRHGAMDYWGQGTLVTVSS

SEQ ID NO: 109 - protein, 107 aa, Artificial Sequence; identical to SEQ ID NO: 73
  Synthetic peptide

SEQ ID NO: 110 - protein, 243 aa, Artificial Sequence
  Synthetic peptide
QVQLVESGGGLVKPGESLRLSCAASGFTFSDYYMYWVRQAPGKCLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 111 - protein, 498 aa, Artificial Sequence
  Synthetic peptide
QVQLVESGGGLVKPGESLRLSCAASGFTFSDYYMYWVRQAPGKCLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 112 - protein, 986 aa, Artificial Sequence
  Synthetic peptide
QVQLVESGGGLVKPGESLRLSCAASGFTFSDYYMYWVRQAPGKCLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 984 aa, Artificial Sequence
  Synthetic peptide
QVQLVESGGGLVKPGESLRLSCAASGFTFSDYYMYWVRQAPGKCLEWVAIISDHYSHTYYSDIIKDRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 5 aa, Artificial Sequence
  Synthetic peptide
DYYMY

SEQ ID NO: 115 - protein, 17 aa, Artificial Sequence
  Synthetic peptide
IISDKRHHTYYSDIIKG

SEQ ID NO: 116 - protein, 12 aa, Artificial Sequence
  Synthetic peptide
GFPLLRHGAMDY

SEQ ID NO: 117 - protein, 11 aa, Artificial Sequence
  Synthetic peptide
KASQNVDTNVA

SEQ ID NO: 118 - protein, 7 aa, Artificial Sequence
  Synthetic peptide
SASYRYS

SEQ ID NO: 119 - protein, 9 aa, Artificial Sequence
  Synthetic peptide
QQYDSYPYT

SEQ ID NO: 120 - protein, 121 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSS

SEQ ID NO: 121 - protein, 107 aa, Artificial Sequence; identical to SEQ ID NO: 67
  Synthetic peptide

SEQ ID NO: 122 - protein, 243 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 123 - protein, 498 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 124 - protein, 986 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 984 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 121 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSS

SEQ ID NO: 127 - protein, 107 aa, Artificial Sequence; identical to SEQ ID NO: 73
  Synthetic peptide

SEQ ID NO: 128 - protein, 243 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 129 - protein, 498 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 130 - protein, 986 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 984 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 5 aa, Artificial Sequence
  Synthetic peptide
DYYMY

SEQ ID NO: 133 - protein, 17 aa, Artificial Sequence
  Synthetic peptide
IISDKRHHTYYSDIIKG

SEQ ID NO: 134 - protein, 12 aa, Artificial Sequence
  Synthetic peptide
GFPLLRHGAMDY

SEQ ID NO: 135 - protein, 11 aa, Artificial Sequence
  Synthetic peptide
KASQNVDTNVA

SEQ ID NO: 136 - protein, 7 aa, Artificial Sequence
  Synthetic peptide
SASYRYS

SEQ ID NO: 137 - protein, 9 aa, Artificial Sequence
  Synthetic peptide
QQYDDLRPT

SEQ ID NO: 138 - protein, 121 aa, Artificial Sequence; identical to SEQ ID NO: 120
  Synthetic peptide

SEQ ID NO: 139 - protein, 107 aa, Artificial Sequence; identical to SEQ ID NO: 85
  Synthetic peptide

SEQ ID NO: 140 - protein, 243 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIK

SEQ ID NO: 141 - protein, 498 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 142 - protein, 986 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 984 aa, Artificial Sequence
  Synthetic peptide
QVQLVESGGGLVKPGESLRLSCAASGFTFSDYYMYWVRQAPGKGLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 144 - protein, 121 aa, Artificial Sequence; identical to SEQ ID NO: 126
  Synthetic peptide

SEQ ID NO: 145 - protein, 107 aa, Artificial Sequence; identical to SEQ ID NO: 91
  Synthetic peptide

SEQ ID NO: 146 - protein, 243 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIK

SEQ ID NO: 147 - protein, 498 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 148 - protein, 986 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 984 aa, Artificial Sequence
  Synthetic peptide
QVQLVESGGGLVKPGESLRLSCAASGFTFSDYYMYWVRQAPGKCLEWVAIISDKRHHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 5 aa, Artificial Sequence
  Synthetic peptide
DYYMY

SEQ ID NO: 151 - protein, 17 aa, Artificial Sequence
  Synthetic peptide
IISDGGYYTYYSDIIKG

SEQ ID NO: 152 - protein, 12 aa, Artificial Sequence
  Synthetic peptide
GFPLLRHGAMDY

SEQ ID NO: 153 - protein, 11 aa, Artificial Sequence
  Synthetic peptide
KASQNVDTNVA

SEQ ID NO: 154 - protein, 7 aa, Artificial Sequence
  Synthetic peptide
SASYRYS

SEQ ID NO: 155 - protein, 9 aa, Artificial Sequence
  Synthetic peptide
QQYDQQLIT

SEQ ID NO: 156 - protein, 121 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 157 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIK

SEQ ID NO: 158 - protein, 243 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIK

SEQ ID NO: 159 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 160 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 121 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSS

SEQ ID NO: 163 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIK

SEQ ID NO: 164 - protein, 243 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIK

SEQ ID NO: 165 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 166 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 5 aa, Artificial Sequence
  Synthetic peptide
DYYMY

SEQ ID NO: 169 - protein, 17 aa, Artificial Sequence
  Synthetic peptide
IISDGGYYTYYSDIIKG

SEQ ID NO: 170 - protein, 12 aa, Artificial Sequence
  Synthetic peptide
GFPLLRHGAMDY

SEQ ID NO: 171 - protein, 11 aa, Artificial Sequence
  Synthetic peptide
KASQNVDTNVA

SEQ ID NO: 172 - protein, 7 aa, Artificial Sequence
  Synthetic peptide
SASYRYS

SEQ ID NO: 173 - protein, 9 aa, Artificial Sequence
  Synthetic peptide
QQYDQVRLT

SEQ ID NO: 174 - protein, 121 aa, Artificial Sequence; identical to SEQ ID NO: 156
  Synthetic peptide

SEQ ID NO: 175 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGGGTKLEIK

SEQ ID NO: 176 - protein, 243 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGGGTKLEIK

SEQ ID NO: 177 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 178 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 121 aa, Artificial Sequence; identical to SEQ ID NO: 162
  Synthetic peptide

SEQ ID NO: 181 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGCGTKLEIK

SEQ ID NO: 182 - protein, 243 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGCGTKLEIK

SEQ ID NO: 183 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 184 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQVRLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - protein, 5 aa, Artificial Sequence
  Synthetic peptide
DYYMN

SEQ ID NO: 187 - protein, 17 aa, Artificial Sequence
  Synthetic peptide
IISDGGYYTYYSDIIKG

SEQ ID NO: 188 - protein, 12 aa, Artificial Sequence
  Synthetic peptide
GFPLLRHGAMDY

SEQ ID NO: 189 - protein, 11 aa, Artificial Sequence
  Synthetic peptide
KASQNVDTNVA

SEQ ID NO: 190 - protein, 7 aa, Artificial Sequence
  Synthetic peptide
SASYRYS

SEQ ID NO: 191 - protein, 9 aa, Artificial Sequence
  Synthetic peptide
QQYDDLRPT

SEQ ID NO: 192 - protein, 121 aa, Artificial Sequence; identical to SEQ ID NO: 48
  Synthetic peptide

SEQ ID NO: 193 - protein, 107 aa, Artificial Sequence; identical to SEQ ID NO: 85
  Synthetic peptide

SEQ ID NO: 194 - protein, 243 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIK

SEQ ID NO: 195 - protein, 498 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 196 - protein, 986 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 984 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 121 aa, Artificial Sequence; identical to SEQ ID NO: 54
  Synthetic peptide

SEQ ID NO: 199 - protein, 107 aa, Artificial Sequence; identical to SEQ ID NO: 91
  Synthetic peptide

SEQ ID NO: 200 - protein, 243 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIK

SEQ ID NO: 201 - protein, 498 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 202 - protein, 986 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 984 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDDLRPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 5 aa, Artificial Sequence
  Synthetic peptide
DYYMY

SEQ ID NO: 205 - protein, 17 aa, Artificial Sequence
  Synthetic peptide
IISDHHHWTYYSDIIKG

SEQ ID NO: 206 - protein, 12 aa, Artificial Sequence
  Synthetic peptide
GFPLLRHGAMDY

SEQ ID NO: 207 - protein, 11 aa, Artificial Sequence
  Synthetic peptide
KASQNVDTNVA

SEQ ID NO: 208 - protein, 7 aa, Artificial Sequence
  Synthetic peptide
SASYRYS

SEQ ID NO: 209 - protein, 9 aa, Artificial Sequence
  Synthetic peptide
QQYDSYPYT

SEQ ID NO: 210 - protein, 121 aa, Artificial Sequence
  Synthetic peptide
QVQLVESGGGLVKPGESLRLSCAASGFTFSDYYMYWVRQAPGKGLEWVAIISDHHHWTYYSDIIKGRFTISRDNAKNSLYLQMNSLKAEDTAVYYCARGFPLLRHGAMDYWGQGTLVTVSS

SEQ ID NO: 211 - protein, 107 aa, Artificial Sequence; identical to SEQ ID NO: 67
  Synthetic peptide

SEQ ID NO: 212 - protein, 243 aa, Artificial Sequence
  Synthetic peptide
QVQLVESGGGLVKPGESLRLSCAASGFTFSDYYMYWVRQAPGKGLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 213 - protein, 498 aa, Artificial Sequence
  Synthetic peptide
QVQLVESGGGLVKPGESLRLSCAASGFTFSDYYMYWVRQAPGKGLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 214 - protein, 986 aa, Artificial Sequence
  Synthetic peptide
QVQLVESGGGLVKPGESLRLSCAASGFTFSDYYMYWVRQAPGKGLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 984 aa, Artificial Sequence
  Synthetic peptide
QVQLVESGGGLVKPGESLRLSCAASGFTFSDYYMYWVRQAPGKGLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 121 aa, Artificial Sequence
  Synthetic peptide
QVQLVESGGGLVKPGESLRLSCAASGFTFSDYYMYWVRQAPGKCLEWVAIISDHHHWTYYSDIIKGRFTISRDNAKNSLYLQMNSLKAEDTAVYYCARGFPLLRHGAMDYWGQGTLVTVSS

SEQ ID NO: 217 - protein, 107 aa, Artificial Sequence; identical to SEQ ID NO: 73
  Synthetic peptide

SEQ ID NO: 218 - protein, 243 aa, Artificial Sequence
  Synthetic peptide
QVQLVESGGGLVKPGESLRLSCAASGFTFSDYYMYWVRQAPGKCLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 219 - protein, 498 aa, Artificial Sequence
  Synthetic peptide
QVQLVESGGGLVKPGESLRLSCAASGFTFSDYYMYWVRQAPGKCLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 220 - protein, 986 aa, Artificial Sequence
  Synthetic peptide
QVQLVESGGGLVKPGESLRLSCAASGFTFSDYYMYWVRQAPGKCLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 984 aa, Artificial Sequence
  Synthetic peptide
QVQLVESGGGLVKPGESLRLSCAASGFTFSDYYMYWVRQAPGKCLEWVAIISDHHHWTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 5 aa, Artificial Sequence
  Synthetic peptide
DYYMY

SEQ ID NO: 223 - protein, 17 aa, Artificial Sequence
  Synthetic peptide
IISDGGYYTYYSDIIKG

SEQ ID NO: 224 - protein, 12 aa, Artificial Sequence
  Synthetic peptide
GFPLLRHGAMDY

SEQ ID NO: 225 - protein, 11 aa, Artificial Sequence
  Synthetic peptide
KASQNVDTNVA

SEQ ID NO: 226 - protein, 7 aa, Artificial Sequence
  Synthetic peptide
SASYRYS

SEQ ID NO: 227 - protein, 9 aa, Artificial Sequence
  Synthetic peptide
QQYDRQPLT

SEQ ID NO: 228 - protein, 121 aa, Artificial Sequence; identical to SEQ ID NO: 156
  Synthetic peptide

SEQ ID NO: 229 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGGGTKLEIK

SEQ ID NO: 230 - protein, 243 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGGGTKLEIK

SEQ ID NO: 231 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 232 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 121 aa, Artificial Sequence; identical to SEQ ID NO: 162
  Synthetic peptide

SEQ ID NO: 235 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGCGTKLEIK

SEQ ID NO: 236 - protein, 243 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGCGTKLEIK

SEQ ID NO: 237 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 238 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDRQPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 5 aa, Artificial Sequence
  Synthetic peptide
DYYMN

SEQ ID NO: 241 - protein, 17 aa, Artificial Sequence
  Synthetic peptide
IISDGGYYTYYSDIIKG

SEQ ID NO: 242 - protein, 12 aa, Artificial Sequence
  Synthetic peptide
GFPLLRHGAMDY

SEQ ID NO: 243 - protein, 11 aa, Artificial Sequence
  Synthetic peptide
KASQNVDTNVA

SEQ ID NO: 244 - protein, 7 aa, Artificial Sequence
  Synthetic peptide
SASYRYS

SEQ ID NO: 245 - protein, 9 aa, Artificial Sequence
  Synthetic peptide
QQYDLLLLT

SEQ ID NO: 246 - protein, 121 aa, Artificial Sequence; identical to SEQ ID NO: 48
  Synthetic peptide

SEQ ID NO: 247 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGGGTKLEIK

SEQ ID NO: 248 - protein, 243 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGGGTKLEIK

SEQ ID NO: 249 - protein, 498 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 250 - protein, 986 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 984 aa, Artificial Sequence
  Synthetic peptide
QVQLVESGGGLVKPGESLRLSCAASGFTFSDYYMNWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 121 aa, Artificial Sequence; identical to SEQ ID NO: 54
  Synthetic peptide

SEQ ID NO: 253 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGCGTKLEIK

SEQ ID NO: 254 - protein, 243 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGCGTKLEIK

SEQ ID NO: 255 - protein, 498 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 256 - protein, 986 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - protein, 984 aa, Artificial Sequence
  Synthetic peptide
QVQLVESGGGLVKPGESLRLSCAASGFTFSDYYMNWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDLLLLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 5 aa, Artificial Sequence
  Synthetic peptide
DYYMY

SEQ ID NO: 259 - protein, 17 aa, Artificial Sequence
  Synthetic peptide
IISDSTLHTYYSDIIKG

SEQ ID NO: 260 - protein, 12 aa, Artificial Sequence
  Synthetic peptide
GFPLLRHGAMDY

SEQ ID NO: 261 - protein, 11 aa, Artificial Sequence
  Synthetic peptide
KASQNVDTNVA

SEQ ID NO: 262 - protein, 7 aa, Artificial Sequence
  Synthetic peptide
SASYRYS

SEQ ID NO: 263 - protein, 9 aa, Artificial Sequence
  Synthetic peptide
QQYDSYPYT

SEQ ID NO: 264 - protein, 121 aa, Artificial Sequence
  Synthetic peptide
QVQLVESGGGLVKPGESLRLSCAASGFTFSDYYMYWVRQAPGKGLEWVAIISDSTLHTYYSDIIKGRFTISRDNAKNSLYLQMNSLKAEDTAVYYCARGFPLLRHGAMDYWGQGTLVTVSS

SEQ ID NO: 265 - protein, 107 aa, Artificial Sequence; identical to SEQ ID NO: 67
  Synthetic peptide

SEQ ID NO: 266 - protein, 243 aa, Artificial Sequence
  Synthetic peptide
QVQLVESGGGLVKPGESLRLSCAASGFTFSDYYMYWVRQAPGKGLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 267 - protein, 498 aa, Artificial Sequence
  Synthetic peptide
QVQLVESGGGLVKPGESLRLSCAASGFTFSDYYMYWVRQAPGKGLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 268 - protein, 986 aa, Artificial Sequence
  Synthetic peptide
QVQLVESGGGLVKPGESLRLSCAASGFTFSDYYMYWVRQAPGKGLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - protein, 984 aa, Artificial Sequence
  Synthetic peptide
QVQLVESGGGLVKPGESLRLSCAASGFTFSDYYMYWVRQAPGKGLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 121 aa, Artificial Sequence
  Synthetic peptide
QVQLVESGGGLVKPGESLRLSCAASGFTFSDYYMYWVRQAPGKCLEWVAIISDSTLHTYYSDIIKGRFTISRDNAKNSLYLQMNSLKAEDTAVYYCARGFPLLRHGAMDYWGQGTLVTVSS

SEQ ID NO: 271 - protein, 107 aa, Artificial Sequence; identical to SEQ ID NO: 73
  Synthetic peptide

SEQ ID NO: 272 - protein, 243 aa, Artificial Sequence
  Synthetic peptide
QVQLVESGGGLVKPGESLRLSCAASGFTFSDYYMYWVRQAPGKCLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 273 - protein, 498 aa, Artificial Sequence
  Synthetic peptide
QVQLVESGGGLVKPGESLRLSCAASGFTFSDYYMYWVRQAPGKCLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 274 - protein, 986 aa, Artificial Sequence
  Synthetic peptide
QVQLVESGGGLVKPGESLRLSCAASGFTFSDYYMYWVRQAPGKCLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 984 aa, Artificial Sequence
  Synthetic peptide
QVQLVESGGGLVKPGESLRLSCAASGFTFSDYYMYWVRQAPGKCLEWVAIISDSTLHTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 5 aa, Artificial Sequence
  Synthetic peptide
DYYMY

SEQ ID NO: 277 - protein, 17 aa, Artificial Sequence
  Synthetic peptide
IISDGGYYTYYSDIIKG

SEQ ID NO: 278 - protein, 12 aa, Artificial Sequence
  Synthetic peptide
GFPLLRHGAMDY

SEQ ID NO: 279 - protein, 11 aa, Artificial Sequence
  Synthetic peptide
KASQNVDTNVA

SEQ ID NO: 280 - protein, 7 aa, Artificial Sequence
  Synthetic peptide
SASYRYS

SEQ ID NO: 281 - protein, 9 aa, Artificial Sequence
  Synthetic peptide
QQYDAPMGT

SEQ ID NO: 282 - protein, 121 aa, Artificial Sequence; identical to SEQ ID NO: 156
  Synthetic peptide

SEQ ID NO: 283 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGGGTKLEIK

SEQ ID NO: 284 - protein, 243 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGGGTKLEIK

SEQ ID NO: 285 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 286 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 121 aa, Artificial Sequence; identical to SEQ ID NO: 162
  Synthetic peptide

SEQ ID NO: 289 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGCGTKLEIK

SEQ ID NO: 290 - protein, 243 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGCGTKLEIK

SEQ ID NO: 291 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 292 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDAPMGTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 5 aa, Artificial Sequence
  Synthetic peptide
DYYMN

SEQ ID NO: 295 - protein, 17 aa, Artificial Sequence
  Synthetic peptide
IISDNKHQTYYSDIIKG

SEQ ID NO: 296 - protein, 12 aa, Artificial Sequence
  Synthetic peptide
GFPLLRHGAMDY

SEQ ID NO: 297 - protein, 11 aa, Artificial Sequence
  Synthetic peptide
KASQNVDTNVA

SEQ ID NO: 298 - protein, 7 aa, Artificial Sequence
  Synthetic peptide
SASYRYS

SEQ ID NO: 299 - protein, 9 aa, Artificial Sequence
  Synthetic peptide
QQYDSYPYT

SEQ ID NO: 300 - protein, 121 aa, Artificial Sequence
  Synthetic peptide
QVQLVESGGGLVKPGESLRLSCAASGFTFSDYYMNWVRQAPGKGLEWVAIISDNKHQTYYSDIIKGRFAISRDNAKNSLYLQMNSLKAEDTAVYYCARGFPLLRHGAMDYWGQGTLVTVSS

SEQ ID NO: 301 - protein, 107 aa, Artificial Sequence; identical to SEQ ID NO: 49
  Synthetic peptide

SEQ ID NO: 302 - protein, 243 aa, Artificial Sequence
  Synthetic peptide
QVQLVESGGGLVKPGESLRLSCAASGFTFSDYYMNWVRQAPGKGLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIK

SEQ ID NO: 303 - protein, 498 aa, Artificial Sequence
  Synthetic peptide
QVQLVESGGGLVKPGESLRLSCAASGFTFSDYYMNWVRQAPGKGLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 304 - protein, 986 aa, Artificial Sequence
  Synthetic peptide
QVQLVESGGGLVKPGESLRLSCAASGFTFSDYYMNWVRQAPGKGLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 984 aa, Artificial Sequence
  Synthetic peptide
QVQLVESGGGLVKPGESLRLSCAASGFTFSDYYMNWVRQAPGKGLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 121 aa, Artificial Sequence
  Synthetic peptide
QVQLVESGGGLVKPGESLRLSCAASGFTFSDYYMNWVRQAPGKCLEWVAIISDNKHQTYYSDIIKGRFAISRDNAKNSLYLQMNSLKAEDTAVYYCARGFPLLRHGAMDYWGQGTLVTVSS

SEQ ID NO: 307 - protein, 107 aa, Artificial Sequence; identical to SEQ ID NO: 55
  Synthetic peptide

SEQ ID NO: 308 - protein, 243 aa, Artificial Sequence
  Synthetic peptide
QVQLVESGGGLVKPGESLRLSCAASGFTFSDYYMNWVRQAPGKCLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIK

SEQ ID NO: 309 - protein, 498 aa, Artificial Sequence
  Synthetic peptide
QVQLVESGGGLVKPGESLRLSCAASGFTFSDYYMNWVRQAPGKCLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 310 - protein, 986 aa, Artificial Sequence
  Synthetic peptide
QVQLVESGGGLVKPGESLRLSCAASGFTFSDYYMNWVRQAPGKCLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 984 aa, Artificial Sequence
  Synthetic peptide
QVQLVESGGGLVKPGESLRLSCAASGFTFSDYYMNWVRQAPGKCLEWVAIISDNKHQTYYSDIIKGRFAISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSLQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 5 aa, Artificial Sequence
  Synthetic peptide
DYYMY

SEQ ID NO: 313 - protein, 17 aa, Artificial Sequence
  Synthetic peptide
IISDAGYYTYYSDIIKG

SEQ ID NO: 314 - protein, 12 aa, Artificial Sequence
  Synthetic peptide
GFPLLRHGAMDY

SEQ ID NO: 315 - protein, 11 aa, Artificial Sequence
  Synthetic peptide
KASQNVDTNVA

SEQ ID NO: 316 - protein, 7 aa, Artificial Sequence
  Synthetic peptide
SASYRYS

SEQ ID NO: 317 - protein, 9 aa, Artificial Sequence
  Synthetic peptide
QQYESYPYT

SEQ ID NO: 318 - protein, 121 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSS

SEQ ID NO: 319 - protein, 107 aa, Artificial Sequence
  Synthetic peptide
DIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIK

SEQ ID NO: 320 - protein, 243 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIK

SEQ ID NO: 321 - protein, 498 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 322 - protein, 986 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - protein, 984 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 324 - protein, 498 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 325 - protein, 986 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - protein, 984 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYESYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 5 aa, Artificial Sequence
  Synthetic peptide
DYYMY

SEQ ID NO: 328 - protein, 17 aa, Artificial Sequence
  Synthetic peptide
IISDGGYYTYYSDIIKG

SEQ ID NO: 329 - protein, 12 aa, Artificial Sequence
  Synthetic peptide
GFPLLRHGAMDY

SEQ ID NO: 330 - protein, 11 aa, Artificial Sequence
  Synthetic peptide
KASQNVDTNVA

SEQ ID NO: 331 - protein, 7 aa, Artificial Sequence
  Synthetic peptide
SASYRYS

SEQ ID NO: 332 - protein, 9 aa, Artificial Sequence
  Synthetic peptide
QQYDQQLIT

SEQ ID NO: 333 - protein, 121 aa, Artificial Sequence; identical to SEQ ID NO: 156
  Synthetic peptide

SEQ ID NO: 334 - protein, 107 aa, Artificial Sequence; identical to SEQ ID NO: 157
  Synthetic peptide

SEQ ID NO: 335 - protein, 243 aa, Artificial Sequence; identical to SEQ ID NO: 158
  Synthetic peptide

SEQ ID NO: 336 - protein, 498 aa, Artificial Sequence; identical to SEQ ID NO: 159
  Synthetic peptide

SEQ ID NO: 337 - protein, 986 aa, Artificial Sequence; identical to SEQ ID NO: 160
  Synthetic peptide

SEQ ID NO: 338 - protein, 984 aa, Artificial Sequence; identical to SEQ ID NO: 161
  Synthetic peptide

SEQ ID NO: 339 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 340 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - protein, 5 aa, Artificial Sequence
  Synthetic peptide
DYYMY

SEQ ID NO: 343 - protein, 17 aa, Artificial Sequence
  Synthetic peptide
IISDGGYYTYYSDIIKG

SEQ ID NO: 344 - protein, 12 aa, Artificial Sequence
  Synthetic peptide
GFPLLRHGAMDY

SEQ ID NO: 345 - protein, 11 aa, Artificial Sequence
  Synthetic peptide
KASQNVDTNVA

SEQ ID NO: 346 - protein, 7 aa, Artificial Sequence
  Synthetic peptide
SASYRYS

SEQ ID NO: 347 - protein, 9 aa, Artificial Sequence
  Synthetic peptide
QQYDQQLIT

SEQ ID NO: 348 - protein, 121 aa, Artificial Sequence; identical to SEQ ID NO: 162
  Synthetic peptide

SEQ ID NO: 349 - protein, 107 aa, Artificial Sequence; identical to SEQ ID NO: 163
  Synthetic peptide

SEQ ID NO: 350 - protein, 243 aa, Artificial Sequence; identical to SEQ ID NO: 164
  Synthetic peptide

SEQ ID NO: 351 - protein, 498 aa, Artificial Sequence; identical to SEQ ID NO: 165
  Synthetic peptide

SEQ ID NO: 352 - protein, 986 aa, Artificial Sequence; identical to SEQ ID NO: 166
  Synthetic peptide

SEQ ID NO: 353 - protein, 984 aa, Artificial Sequence; identical to SEQ ID NO: 167
  Synthetic peptide

SEQ ID NO: 354 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 355 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 5 aa, Artificial Sequence
  Synthetic peptide
DYYMY

SEQ ID NO: 358 - protein, 17 aa, Artificial Sequence
  Synthetic peptide
IISDGGYYTYYSDIIKG

SEQ ID NO: 359 - protein, 12 aa, Artificial Sequence
  Synthetic peptide
GFPLLRHGAMDY

SEQ ID NO: 360 - protein, 11 aa, Artificial Sequence
  Synthetic peptide
KASQNVDTNVA

SEQ ID NO: 361 - protein, 7 aa, Artificial Sequence
  Synthetic peptide
SASYVYW

SEQ ID NO: 362 - protein, 9 aa, Artificial Sequence
  Synthetic peptide
QQYDQQLIT

SEQ ID NO: 363 - protein, 121 aa, Artificial Sequence; identical to SEQ ID NO: 156
  Synthetic peptide

SEQ ID NO: 364 - protein, 107 aa, Artificial Sequence
  Synthetic peptide
DIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIK

SEQ ID NO: 365 - protein, 243 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIK

SEQ ID NO: 366 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 367 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 368 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 370 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 372 - protein, 5 aa, Artificial Sequence
  Synthetic peptide
DYYMY

SEQ ID NO: 373 - protein, 17 aa, Artificial Sequence
  Synthetic peptide
IISDGGYYTYYSDIIKG

SEQ ID NO: 374 - protein, 12 aa, Artificial Sequence
  Synthetic peptide
GFPLLRHGAMDY

SEQ ID NO: 375 - protein, 11 aa, Artificial Sequence
  Synthetic peptide
KASQNVDTNVA

SEQ ID NO: 376 - protein, 7 aa, Artificial Sequence
  Synthetic peptide
SASYVYW

SEQ ID NO: 377 - protein, 9 aa, Artificial Sequence
  Synthetic peptide
QQYDQQLIT

SEQ ID NO: 378 - protein, 121 aa, Artificial Sequence; identical to SEQ ID NO: 162
  Synthetic peptide

SEQ ID NO: 379 - protein, 107 aa, Artificial Sequence
  Synthetic peptide
DIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 380 - protein, 243 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 381 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 382 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 384 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 385 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 386 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 387 - protein, 5 aa, Artificial Sequence
  Synthetic peptide
DYYMY

SEQ ID NO: 388 - protein, 17 aa, Artificial Sequence
  Synthetic peptide
IISDAGYYTYYSDIIKG

SEQ ID NO: 389 - protein, 12 aa, Artificial Sequence
  Synthetic peptide
GFPLLRHGAMDY

SEQ ID NO: 390 - protein, 11 aa, Artificial Sequence
  Synthetic peptide
KASQNVDANVA

SEQ ID NO: 391 - protein, 7 aa, Artificial Sequence
  Synthetic peptide
SASYRYS

SEQ ID NO: 392 - protein, 9 aa, Artificial Sequence
  Synthetic peptide
QQYDQQLIT

SEQ ID NO: 393 - protein, 121 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSS

SEQ ID NO: 394 - protein, 107 aa, Artificial Sequence
  Synthetic peptide
DIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIK

SEQ ID NO: 395 - protein, 243 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIK

SEQ ID NO: 396 - protein, 498 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 397 - protein, 986 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 398 - protein, 984 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 498 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 400 - protein, 986 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 984 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 5 aa, Artificial Sequence
  Synthetic peptide
DYYMY

SEQ ID NO: 403 - protein, 17 aa, Artificial Sequence
  Synthetic peptide
IISDAGYYTYYSDIIKG

SEQ ID NO: 404 - protein, 12 aa, Artificial Sequence
  Synthetic peptide
GFPLLRHGAMDY

SEQ ID NO: 405 - protein, 11 aa, Artificial Sequence
  Synthetic peptide
KASQNVDANVA

SEQ ID NO: 406 - protein, 7 aa, Artificial Sequence
  Synthetic peptide
SASYRYS

SEQ ID NO: 407 - protein, 9 aa, Artificial Sequence
  Synthetic peptide
QQYDQQLIT

SEQ ID NO: 408 - protein, 121 aa, Artificial Sequence; identical to SEQ ID NO: 318
  Synthetic peptide

SEQ ID NO: 409 - protein, 107 aa, Artificial Sequence
  Synthetic peptide
DIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIK

SEQ ID NO: 410 - protein, 243 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIK

SEQ ID NO: 411 - protein, 498 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 412 - protein, 986 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 984 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 498 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 415 - protein, 986 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - protein, 984 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYRYSDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 5 aa, Artificial Sequence
  Synthetic peptide
DYYMY

SEQ ID NO: 418 - protein, 17 aa, Artificial Sequence
  Synthetic peptide
IISDAGYYTYYSDIIKG

SEQ ID NO: 419 - protein, 12 aa, Artificial Sequence
  Synthetic peptide
GFPLLRHGAMDY

SEQ ID NO: 420 - protein, 11 aa, Artificial Sequence
  Synthetic peptide
KASQNVDANVA

SEQ ID NO: 421 - protein, 7 aa, Artificial Sequence
  Synthetic peptide
SASYVYW

SEQ ID NO: 422 - protein, 9 aa, Artificial Sequence
  Synthetic peptide
QQYDQQLIT

SEQ ID NO: 423 - protein, 121 aa, Artificial Sequence; identical to SEQ ID NO: 393
  Synthetic peptide

SEQ ID NO: 424 - protein, 107 aa, Artificial Sequence
  Synthetic peptide
DIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIK

SEQ ID NO: 425 - protein, 243 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIK

SEQ ID NO: 426 - protein, 498 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 427 - protein, 986 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 428 - protein, 984 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 498 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 430 - protein, 986 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 431 - protein, 984 aa, Artificial Sequence
  Synthetic peptide
QVQLVESGGGLVKPGESLRLSCAASGFTFSDYYMYWVRQAPGKGLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - protein, 5 aa, Artificial Sequence
  Synthetic peptide
DYYMY

SEQ ID NO: 433 - protein, 17 aa, Artificial Sequence
  Synthetic peptide
IISDAGYYTYYSDIIKG

SEQ ID NO: 434 - protein, 12 aa, Artificial Sequence
  Synthetic peptide
GFPLLRHGAMDY

SEQ ID NO: 435 - protein, 11 aa, Artificial Sequence
  Synthetic peptide
KASQNVDANVA

SEQ ID NO: 436 - protein, 7 aa, Artificial Sequence
  Synthetic peptide
SASYVYW

SEQ ID NO: 437 - protein, 9 aa, Artificial Sequence
  Synthetic peptide
QQYDQQLIT

SEQ ID NO: 438 - protein, 121 aa, Artificial Sequence; identical to SEQ ID NO: 318
  Synthetic peptide

SEQ ID NO: 439 - protein, 107 aa, Artificial Sequence
  Synthetic peptide
DIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIK

SEQ ID NO: 440 - protein, 243 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIK

SEQ ID NO: 441 - protein, 498 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 442 - protein, 986 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 984 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 444 - protein, 498 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 445 - protein, 986 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 446 - protein, 984 aa, Artificial Sequence
  Synthetic peptide
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 447 - protein, 5 aa, Artificial Sequence
  Synthetic peptide
DYYMY

SEQ ID NO: 448 - protein, 17 aa, Artificial Sequence
  Synthetic peptide
IISDGGYYTYYSDIIKG

SEQ ID NO: 449 - protein, 12 aa, Artificial Sequence
  Synthetic peptide
GFPLLRHGAMDY

SEQ ID NO: 450 - protein, 11 aa, Artificial Sequence
  Synthetic peptide
KASQNVDTNVA

SEQ ID NO: 451 - protein, 7 aa, Artificial Sequence
  Synthetic peptide
SASYRYS

SEQ ID NO: 452 - protein, 9 aa, Artificial Sequence
  Synthetic peptide
QQYDSYPYT

SEQ ID NO: 453 - protein, 121 aa, Artificial Sequence; identical to SEQ ID NO: 156
  Synthetic peptide

SEQ ID NO: 454 - protein, 107 aa, Artificial Sequence; identical to SEQ ID NO: 67
  Synthetic peptide

SEQ ID NO: 455 - protein, 243 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 456 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 457 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 459 - protein, 498 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 460 - protein, 986 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - protein, 984 aa, Artificial Sequence
  Synthetic peptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 5 aa, Artificial Sequence
  Synthetic peptide
DYYMY

SEQ ID NO: 463 - protein, 17 aa, Artificial Sequence
  Synthetic peptide
IISDGGYYTYYSDIIKG

SEQ ID NO: 464 - protein, 12 aa, Artificial Sequence
  Synthetic peptide
GFPLLRHGAMDY

SEQ ID NO: 465 - protein, 11 aa, Artificial Sequence
  Synthetic peptide
KASQNVDTNVA

SEQ ID NO: 466 - protein, 7 aa, Artificial Sequence
  Synthetic peptide
SASYRYS

SEQ ID NO: 467 - protein, 9 aa, Artificial Sequence
  Synthetic peptide
QQYDSYPYT

SEQ ID NO: 468 - protein, 121 aa, Artificial Sequence; identical to SEQ ID NO: 162
  Synthetic peptide

SEQ ID NO: 469 - protein, 107 aa, Artificial Sequence; identical to SEQ ID NO: 73
  Synthetic peptide

SEQ ID NO: 470 - protein, 243 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIK

SEQ ID NO: 471 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 472 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 498 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVL

SEQ ID NO: 475 - protein, 986 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 984 aa, Artificial Sequence
  Synthetic peptide
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 10 aa, Artificial Sequence
  Synthetic peptide
DKTHTCPPCP

SEQ ID NO: 478 - protein, 12 aa, Artificial Sequence
  Synthetic peptide
ERKCCVECPPCP

SEQ ID NO: 479 - protein, 16 aa, Artificial Sequence
  Synthetic peptide
ELKTPLDTTHTCPRCP

SEQ ID NO: 480 - protein, 12 aa, Artificial Sequence
  Synthetic peptide
ESKYGPPCPSCP

SEQ ID NO: 481 - protein, 994 aa, Artificial Sequence
  Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 984 aa, Artificial Sequence
  Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 1004 aa, Artificial Sequence
  Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 994 aa, Artificial Sequence
  Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGGGGSGGGGSGGGGSGGGGSAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 984 aa, Artificial Sequence
  Synthetic peptide
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGGGGSGGGGSGGGGSGGGGSAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 17 aa, Artificial Sequence
  Synthetic peptide
ELKTPLGDTTHTCPRCP

SEQ ID NO: 487 - protein, 15 aa, Artificial Sequence
  Synthetic peptide
EPKSCDKTHTCPPCP

SEQ ID NO: 488 - protein, 249 aa, Artificial Sequence
  Synthetic Polypeptide
  MISC_FEATURE: VH-VL of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 489 - protein, 249 aa, Artificial Sequence
  Synthetic Polypeptide
  MISC_FEATURE: VH-VL-P of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 490 - protein, 249 aa, Artificial Sequence
  Synthetic Polypeptide
  MISC_FEATURE: VH-VL of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 491 - protein, 249 aa, Artificial Sequence
  Synthetic Polypeptide
  MISC_FEATURE: VH-VL-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 492 - protein, 249 aa, Artificial Sequence
  Synthetic Polypeptide
  MISC_FEATURE: VH-VL of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 493 - protein, 249 aa, Artificial Sequence
  Synthetic Polypeptide
  MISC_FEATURE: VH-VL-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 494 - protein, 249 aa, Artificial Sequence
  Synthetic Polypeptide
  MISC_FEATURE: VH-VL of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 495 - protein, 249 aa, Artificial Sequence
  Synthetic Polypeptide
  MISC_FEATURE: VH-VL-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 496 - protein, 249 aa, Artificial Sequence
  Synthetic Polypeptide
  MISC_FEATURE: VH-VL of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 497 - protein, 249 aa, Artificial Sequence
  Synthetic Polypeptide
  MISC_FEATURE: VH-VL-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 498 - protein, 249 aa, Artificial Sequence
  Synthetic Polypeptide
  MISC_FEATURE: VH-VL of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 499 - protein, 249 aa, Artificial Sequence
  Synthetic Polypeptide
  MISC_FEATURE: VH-VL-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 500 - protein, 249 aa, Artificial Sequence
  Synthetic Polypeptide
  MISC_FEATURE: VH-VL of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 501 - protein, 249 aa, Artificial Sequence
  Synthetic Polypeptide
  MISC_FEATURE: VH-VL-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 502 - protein, 249 aa, Artificial Sequence
  Synthetic Polypeptide
  MISC_FEATURE: VH-VL of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 503 - protein, 249 aa, Artificial Sequence
  Synthetic Polypeptide
  MISC_FEATURE: VH-VL-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 504 - protein, 249 aa, Artificial Sequence
  Synthetic Polypeptide
  MISC_FEATURE: VH-VL of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 505 - protein, 249 aa, Artificial Sequence
  Synthetic Polypeptide
  MISC_FEATURE: VH-VL-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 506 - protein, 249 aa, Artificial Sequence
  Synthetic Polypeptide
  MISC_FEATURE: VH-VL of I2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 507 - protein, 249 aa, Artificial Sequence
  Synthetic Polypeptide
  MISC_FEATURE: VH-VL-P of I2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 508 - protein, 14 aa, Artificial
  unknown organism
GSSTGAVTSGYYPN

SEQ ID NO: 509 - protein, 7 aa, Artificial
  unknown organism
GTKFLAP

SEQ ID NO: 510 - protein, 9 aa, Artificial
  unknown organism
ALWYSNRWV

SEQ ID NO: 511 - protein, 14 aa, Artificial
  unknown organism
RSSTGAVTSGYYPN

SEQ ID NO: 512 - protein, 7 aa, Artificial
  unknown organism
ATDMRPS

SEQ ID NO: 513 - protein, 9 aa, Artificial
  unknown organism
ALWYSNRWV

SEQ ID NO: 514 - protein, 14 aa, Artificial
  unknown organism
GSSTGAVTSGNYPN

SEQ ID NO: 515 - protein, 7 aa, Artificial
  unknown organism
GTKFLAP

SEQ ID NO: 516 - protein, 9 aa, Artificial
  unknown organism
VLWYSNRWV

SEQ ID NO: 517 - protein, 5 aa, Artificial
  unknown organism
IYAMN

SEQ ID NO: 518 - protein, 19 aa, Artificial
  unknown organism
RIRSKYNNYATYYADSVKS

SEQ ID NO: 519 - protein, 14 aa, Artificial
  unknown organism
HGNFGNSYVSFFAY

SEQ ID NO: 520 - protein, 5 aa, Artificial
  unknown organism
KYAMN

SEQ ID NO: 521 - protein, 19 aa, Artificial
  unknown organism
RIRSKYNNYATYYADSVKD

SEQ ID NO: 522 - protein, 14 aa, Artificial
  unknown organism
HGNFGNSYISYWAY

SEQ ID NO: 523 - protein, 5 aa, Artificial
  unknown organism
SYAMN

SEQ ID NO: 524 - protein, 19 aa, Artificial
  unknown organism
RIRSKYNNYATYYADSVKG

SEQ ID NO: 525 - protein, 14 aa, Artificial
  unknown organism
HGNFGNSYLSFWAY

SEQ ID NO: 526 - protein, 5 aa, Artificial
  unknown organism
RYAMN

SEQ ID NO: 527 - protein, 19 aa, Artificial
  unknown organism
RIRSKYNNYATYYADSVKG

SEQ ID NO: 528 - protein, 14 aa, Artificial
  unknown organism
HGNFGNSYLSYFAY

SEQ ID NO: 529 - protein, 5 aa, Artificial
  unknown organism
VYAMN

SEQ ID NO: 530 - protein, 19 aa, Artificial
  unknown organism
RIRSKYNNYATYYADSVKK

SEQ ID NO: 531 - protein, 14 aa, Artificial
  unknown organism
HGNFGNSYLSWWAY

SEQ ID NO: 532 - protein, 5 aa, Artificial
  unknown organism
KYAMN

SEQ ID NO: 533 - protein, 19 aa, Artificial
  unknown organism
RIRSKYNNYATYYADSVKS

SEQ ID NO: 534 - protein, 14 aa, Artificial
  unknown organism
HGNFGNSYTSYYAY

SEQ ID NO: 535 - protein, 5 aa, Artificial
  unknown organism
GYAMN

SEQ ID NO: 536 - protein, 19 aa, Artificial
  unknown organism
RIRSKYNNYATYYADSVKE

SEQ ID NO: 537 - protein, 14 aa, Artificial
  unknown organism
HRNFGNSYLSWFAY

SEQ ID NO: 538 - protein, 5 aa, Artificial
  unknown organism
VYAMN

SEQ ID NO: 539 - protein, 19 aa, Artificial
  unknown organism
RIRSKYNNYATYYADSVKK

SEQ ID NO: 540 - protein, 14 aa, Artificial
  unknown organism
HGNFGNSYISWWAY

SEQ ID NO: 541 - protein, 5 aa, Artificial
  unknown organism
SYAMN

SEQ ID NO: 542 - protein, 19 aa, Artificial
  unknown organism
RIRSKYNNYATYYADSVKG

SEQ ID NO: 543 - protein, 14 aa, Artificial
  unknown organism
HGNFGNSYVSWWAY

SEQ ID NO: 544 - protein, 5 aa, Artificial
  unknown organism
KYAMN

SEQ ID NO: 545 - protein, 19 aa, Artificial
  unknown organism
RIRSKYNNYATYYADSVKD

SEQ ID NO: 546 - protein, 14 aa, Artificial
  unknown organism
HGNFGNSYISYWAY

SEQ ID NO: 547 - protein, 109 aa, Artificial
  unknown organism
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 548 - protein, 109 aa, Artificial
  unknown organism
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 549 - protein, 109 aa, Artificial; identical to SEQ ID NO: 547
  unknown organism

SEQ ID NO: 550 - protein, 109 aa, Artificial; identical to SEQ ID NO: 548
  unknown organism

SEQ ID NO: 551 - protein, 48 aa, Artificial
  unknown organism
QTVVTQEPSLTVSPGGTVTLTCGSSTGAVTSGYYPNWVQQKPGQAPRG

SEQ ID NO: 552 - protein, 170 aa, Artificial
  unknown organism
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLLIGGTKFLAPGTPARFSGSLLGGKAALTLSGVQPEDEAEYYCALWYSNRWVFGGGTKLTVL

SEQ ID NO: 553 - protein, 109 aa, Artificial; identical to SEQ ID NO: 547
  unknown organism

SEQ ID NO: 554 - protein, 109 aa, Artificial; identical to SEQ ID NO: 548
  unknown organism

SEQ ID NO: 555 - protein, 109 aa, Artificial
  unknown organism
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 556 - protein, 109 aa, Artificial
  unknown organism
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 557 - protein, 109 aa, Artificial; identical to SEQ ID NO: 547
  unknown organism

SEQ ID NO: 558 - protein, 109 aa, Artificial; identical to SEQ ID NO: 548
  unknown organism

SEQ ID NO: 559 - protein, 109 aa, Artificial; identical to SEQ ID NO: 555
  unknown organism

SEQ ID NO: 560 - protein, 109 aa, Artificial; identical to SEQ ID NO: 556
  unknown organism

SEQ ID NO: 561 - protein, 109 aa, Artificial; identical to SEQ ID NO: 547
  unknown organism

SEQ ID NO: 562 - protein, 109 aa, Artificial; identical to SEQ ID NO: 548
  unknown organism

SEQ ID NO: 563 - protein, 109 aa, Artificial; identical to SEQ ID NO: 13
  unknown organism

SEQ ID NO: 564 - protein, 109 aa, Artificial
  unknown organism
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 565 - protein, 109 aa, Artificial; identical to SEQ ID NO: 13
  unknown organism

SEQ ID NO: 566 - protein, 109 aa, Artificial; identical to SEQ ID NO: 564
  unknown organism

SEQ ID NO: 567 - protein, 125 aa, Artificial
  unknown organism
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 568 - protein, 125 aa, Artificial
  unknown organism
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 569 - protein, 125 aa, Artificial; identical to SEQ ID NO: 568
  unknown organism

SEQ ID NO: 570 - protein, 125 aa, Artificial
  unknown organism
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 571 - protein, 125 aa, Artificial
  unknown organism
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 572 - protein, 125 aa, Artificial
  unknown organism
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 573 - protein, 125 aa, Artificial
  unknown organism
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 574 - protein, 125 aa, Artificial
  unknown organism
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 575 - protein, 125 aa, Artificial
  unknown organism
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 576 - protein, 125 aa, Artificial
  unknown organism
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 577 - protein, 125 aa, Artificial
  unknown organism
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 578 - protein, 125 aa, Artificial
  unknown organism
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 579 - protein, 125 aa, Artificial
  unknown organism
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 580 - protein, 125 aa, Artificial
  unknown organism
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 581 - protein, 125 aa, Artificial
  unknown organism
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 582 - protein, 125 aa, Artificial
  unknown organism
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 583 - protein, 125 aa, Artificial
  unknown organism
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 584 - protein, 125 aa, Artificial
  unknown organism
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 585 - protein, 125 aa, Artificial
  unknown organism
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 586 - protein, 125 aa, Artificial; identical to SEQ ID NO: 570
  unknown organism

The invention claimed is:

1. An antibody construct comprising:
   a first domain that binds prostate-specific membrane antigen (PSMA) comprising a VH region comprising a CDR-H1 comprising SEQ ID NO: 372, a CDR-H2 comprising SEQ ID NO: 373, and a CDR-H3 comprising SEQ ID NO: 374, and a VL region comprising a CDR-L1 comprising SEQ ID NO: 375, a CDR-L2 comprising SEQ ID NO: 376, and a CDR-L3 comprising SEQ ID NO: 377;
   a second domain that binds to an extracellular epitope of the human and *Macaca* CD3 epsilon (CD3E) chain comprising a VH region comprising a CDR-H1 comprising SEQ ID NO: 544, a CDR-H2 comprising SEQ ID NO: 545, and a CDR-H3 comprising SEQ ID NO: 546, and a VL region comprising a CDR-L1 comprising SEQ ID NO: 514, a CDR-L2 comprising SEQ ID NO: 515, and a CDR-L3 comprising SEQ ID NO: 516; and
   a third domain comprising two Fc monomers, each comprising a hinge, a CH2 domain and a CH3 domain, and each Fc monomer comprising the amino acid sequence of SEQ ID NO: 17, wherein the two Fc monomers are fused to each other via a peptide linker.

2. The antibody construct of claim 1, wherein:
   the first domain comprises a VH region comprising at least 90% identity to the amino acid sequence of SEQ ID NO: 378 and a VL region comprising at least 90% identity to the amino acid sequence of SEQ ID NO: 379; and
   the second domain comprises a VH region comprising at least 90% identity to the amino acid sequence of SEQ ID NO: 585 and a VL region comprising at least 90% identity to the amino acid sequence of SEQ ID NO: 565.

3. The antibody construct of claim 2, wherein:
   the first domain comprises a VH region comprising the amino acid sequence of SEQ ID NO: 378 and a VL region comprising the amino acid sequence of SEQ ID NO: 379;
   the second domain comprises a VH region comprising the amino acid sequence of SEQ ID NO: 585 and a VL region comprising the amino acid sequence of SEQ ID NO: 565; and
   the third domain comprises the amino acid sequence of SEQ ID NO: 25.

4. The antibody construct of claim 1, wherein:
   the first domain comprises at least 90% identity to the amino acid sequence of SEQ ID NO: 380; and
   the second domain comprises at least 90% identity to the amino acid sequence of SEQ ID NO: 506.

5. The antibody construct of claim 4, wherein:
   the first domain comprises the amino acid sequence of SEQ ID NO: 380;
   the second domain comprises the amino acid sequence of SEQ ID NO: 506; and
   the third domain comprises the amino acid sequence of SEQ ID NO: 25.

6. The antibody construct of claim 5, wherein the antibody construct comprises the amino acid sequence of SEQ ID NO: 382.

7. The antibody construct of claim 1, wherein the antibody construct is a single chain antibody construct.

8. The antibody construct of claim 1, wherein the antibody construct comprises in an amino to carboxyl order:
   the first domain, a first peptide linker, the second domain, a second peptide linker, and the third domain.

9. The antibody construct of claim 1, wherein the the third domain comprises the amino acid sequence of SEQ ID NO: 25.

10. The antibody construct of claim 1, wherein the CH2 domain in each Fc monomer comprises an intra domain cysteine disulfide bridge.

11. The antibody construct of claim 1, wherein the first and second domains are fused to the third domain via a peptide linker.

12. The antibody construct of claim 1, wherein the antibody construct comprises in an amino to carboxyl order:
   (a) the first domain;
   (b) a peptide linker having an amino acid sequence selected from the group consisting of SEQ ID NOs: 1-3;
   (c) the second domain;
   (d) a peptide linker having an amino acid sequence selected from the group consisting of SEQ ID NOs: 1, 2, 3, 9, 10, 11 and 12;

(e) the first Fc monomer of the third domain;
(f) a peptide linker having an amino acid sequence selected from the group consisting of SEQ ID NOs: 5, 6, 7 and 8; and
(g) the second Fc monomer of the third domain.

13. The antibody construct of claim 1, wherein the antibody construct comprises in an amino to carboxyl order:
   (a) the first domain comprising the amino acid sequence of SEQ ID NO: 380;
   (b) a peptide linker having an amino acid sequence selected from the group consisting of SEQ ID NOs: 1-3;
   (c) the second domain comprising the amino acid sequence of SEQ ID NO: 506;
   (d) a peptide linker having an amino acid sequence selected from the group consisting of SEQ ID NOs: 1, 2, 3, 9, 10, 11 and 12;
   (e) the first Fc monomer of the third domain comprising the amino acid sequence of SEQ ID NO: 17;
   (f) a peptide linker having an amino acid sequence selected from the group consisting of SEQ ID NOs: 5, 6, 7 and 8; and
   (g) the second Fc monomer of the third domain comprising the amino acid sequence of SEQ ID NO: 17.

14. The antibody construct of claim 1, wherein the first domain and the second domain are each single-chain variable fragments (scFv).

15. The antibody construct of claim 14, wherein the VH and VL regions in each scFv are arranged in the order VH-VL.

16. A polynucleotide comprising a nucleotide sequence encoding the antibody construct of claim 1.

17. A vector comprising the polynucleotide of claim 16.

18. A host cell transformed or transfected with the polynucleotide of claim 16.

19. A composition comprising the antibody construct of claim 1 and a carrier, stabilizer, excipient, diluent, solubilizer, surfactant, emulsifier, preservative or adjuvant.

20. A method of treating or ameliorating prostate cancer in a subject having prostate cancer expressing PSMA comprising administering to the subject an effective amount of the antibody construct of claim 1.

21. A method of treating or ameliorating cancer in a subject having a cancer expressing PSMA comprising administering to the subject an effective amount of the antibody construct of claim 1.

22. A process for producing an antibody construct that binds to PSMA and human and *Macaca* CD3ε chain, said process comprising culturing a host cell transformed or transfected with the polynucleotide of claim 16 under conditions allowing the expression of the antibody construct, and recovering the antibody construct from the culture.

* * * * *

UNITED STATES PATENT AND TRADEMARK OFFICE
CERTIFICATE OF CORRECTION

PATENT NO. : 10,781,264 B2
APPLICATION NO. : 15/422661
DATED : September 22, 2020
INVENTOR(S) : Tobias Raum et al.

It is certified that error appears in the above-identified patent and that said Letters Patent is hereby corrected as shown below:

In the Specification

At Column 15, Line 19, "CD3E" should be --CD3ε--.

At Column 28, Line 20, "(SEQ ID NO: 534 herein;" should be --(SEQ ID NO: 534 herein);--.

At Column 28, Line 25, "(SEQ ID NO: 537 herein;" should be --(SEQ ID NO: 537 herein);--.

At Column 28, Line 30, "(SEQ ID NO: 540 herein;" should be --(SEQ ID NO: 540 herein);--.

At Column 28, Line 57, "WO 2008/119567 WO 2008/119567" should be --WO 2008/119567--.

At Column 89, Line 27, "Example 14 Results" should be --Example 14. Results--.

At Column 89, Line 62, "Example 14 Results" should be --Example 14. Results--.

At Column 90, Line 26, "Example 14 Results" should be --Example 14. Results--.

At Column 90, Line 59, "Example 14 Relative" should be --Example 14. Relative--.

At Column 91, Line 23, "Example 14 An" should be --Example 14. An--.

At Column 91, Line 64, "Example 14 Results" should be --Example 14. Results--.

At Column 92, Lines 14-15, "Example 14 Results" should be --Example 14. Results--.

At Column 92, Line 36, "Example 14 Relative" should be --Example 14. Relative--.

Signed and Sealed this
Twenty-seventh Day of April, 2021

Drew Hirshfeld
*Performing the Functions and Duties of the*
*Under Secretary of Commerce for Intellectual Property and*
*Director of the United States Patent and Trademark Office*

In the Claims

At Column 215, Line 35, "(CD3E)" should be --(CD3ε)--.

At Column 216, Line 48, "wherein the the third domain" should be --wherein the third domain--.